United States Patent 11,999,947 (ADENOSINE NUCLEOBASE EDITORS AND USES THEREOF) - sequence listing, part 2

SEQ ID NO: 270 - protein, 1327 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 271 - protein, 1355 aa, Streptococcus phocae
KKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKDGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 272 - protein, 1361 aa, Streptococcus pseudopneumoniae
SNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLSRDPKEIEKATEKYFFYSNLLNFFKEEVHYADGTIVKRENIEYSKDTGEIAWNKEIDFATIRKILSLSQVNIVKKTEEQTGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 273 - protein, 1361 aa, Streptococcus pseudopneumoniae
SNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLSKDPKDIEKATEKYFFYSNLLNFFKEEVHYADGTIVKRENIEYSKDTGEIAWNKEKDFATIKKILSLPQVNIVKKTEEQTGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 274 - protein, 1363 aa, Streptococcus pseudopneumoniae
SNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLSKDPKDIEKATEKYFFYSNLLNFFKEEVHYADGTIVKRENIEYSKDTGEIAWNKEKDFATIKKVLSYPQVNIVKKTEEQTGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 275 - protein, 1360 aa, Streptococcus pseudoporcinus
YSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 276 - protein, 1316 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 277 - protein, 1359 aa, Streptococcus sanguinis
KKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 278 - protein, 1362 aa, Streptococcus sanguinis
KKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLSKASNTIDKATEKYFFYSNLLNFFKEKVRYADGTIKKRENIEYSNDTGEIAWNKEKDFATIKKVLSLPQVNIVKKTEEQTGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 279 - protein, 1360 aa, unidentified
  source 1..1360: note = Streptococcus sp. F0441
ENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 280 - protein, 1360 aa, unidentified
  source 1..1360: note = Streptococcus sp. FF10
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 281 - protein, 1364 aa, unidentified
  source 1..1364: note = Streptococcus sp. FF10
SNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 282 - protein, 1360 aa, unidentified
  source 1..1360: note = Streptococcus sp. taxon 056
NNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 283 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 284 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 285 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 286 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 287 - protein, 1351 aa, Streptococcus suis
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 288 - protein, 1256 aa, Brochothrix thermosphacta
MWGVSLFEAGKTAAERRGYRSTRRRLNHRKFRLRLLEDMFEKEILSKDPSFFIRLKEAFLSPKDEQKQFLFNDKDYTDADYYEQYKTIYHLRYDLISQHRQFDIREVYLAIHHLIKYRGHFIYEDQTFTTDGNQLQHHIKAIITMINSTLNRIIPETIDINVFEKILLDRMMNRSSKVKFLIELTGKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGYEESKSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPEDHKLSINEILQTNENFMQIIRNKDYLFKKIIEEQFENETALLNKQRIDELAASPANKKGIWQAIKIVKELEKVLQQPAENIFIEFARSDEESKRSTPRDKFIEKAYAETDTEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKAAKPKFTFIVENLSKQQNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGSERHNARQLIVSDEAAKVIWLISTKQADEAMFLKYYRLEHLEAVFEELIRKQAADYQIFEKLIKKIEVNFYSCTYNEKVKVIELLKITQANATNGDLKLLKMSNREGRLGSVSVALDFKIINQSVTGLYQSIEDYNN

SEQ ID NO: 289 - protein, 1290 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDIFTQFTSFNNIPYEDDKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRKAPVDEFYKYVKKCIEKVDTPEAKQILNDIELENFLLKQNSRTNGSVPYQMQLDEMIKIIDNQAEYYPILKEKREQLLSILTFRIPYYFGPLETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADSVTVLDVLESRLNLMEIINDKDLGYAQMIEEATSCPEDGKFTYEEVERLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQLFNTVLSNDAHADKGAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSEYVNARQLVLNEKQCALIADIYNAIYKQDYDNLDDILMIQLYIELTNKMKVLYPAYRGIAEKFESYVVISKEEKANIIQMLIVMHRGPQNGNIVYDDFKISDRIGRLKTKNHNLNIVFISQSPTGIYTKKYKL

SEQ ID NO: 290 - protein, 1359 aa, synthetic construct; identical to SEQ ID NO: 108

SEQ ID NO: 291 - protein, 1317 aa, unidentified
  source 1..1317: note = Clostridiales bacterium S5-A11
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENNDELLTQIENIFKQDISRSKKLDQAIALFQGKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKLLEKDEDEILEEIIKILTIFEDRKMRKRQLMKFKDKLSEKAINQLSKKHYTGWGQLSEKLINGIRDEQSNKTILDYLIDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 292 - protein, 1359 aa, synthetic construct; identical to SEQ ID NO: 108

SEQ ID NO: 293 - protein, 1327 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLED

SEQ ID NO: 294 - protein, 1329 aa, synthetic construct
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 295 - protein, 1280 aa, synthetic construct
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 296 - protein, 1072 aa, Enterococcus durans
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNELLEQPEMNAMFEDIVKILTIFEDREMIRTQLKKYQSVLGDGFFKKLVKKHYTGWGRLSERLINGIRDKKTNKTILDYLIDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 297 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 298 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 299 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 300 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 301 - protein, 1331 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 302 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 303 - protein, 1329 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 304 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 305 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 306 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 307 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 308 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 309 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 310 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 311 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 312 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 313 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 314 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 315 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 316 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 317 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 318 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 319 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 320 - protein, 1324 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASSETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 321 - protein, 1323 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSTLLDDPDMTTMFEEIIKILTIFEDREMIREQLKPYETVLGLPAIKKLAKKHYTGWGRLSEKMIQGMREKQSRKTILDYLIDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGER

SEQ ID NO: 322 - protein, 1330 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 323 - protein, 1327 aa, unidentified
  source 1..1327: note = Enterococcus sp. AM1
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLIDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 324 - protein, 1332 aa, Enterococcus villorum
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYELLEQPEMEEMFEDIVKIITIFEDREMVRTQLKKYQRILGEEIFKKLVKKKYTGWGRLSKRLINGIRDQKTNKTILDYLIDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 325 - protein, 1359 aa, synthetic construct
ADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 326 - protein, 1300 aa, Kandleria vitulina
NNKIYNIGLDIGDASVGWAVVDEHYNLLKRHGKHMWGSRLFTQANTAVERRSSRSTRRRYNKRRERIRLLRGIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKADKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVLAKNSLTVSKYEVLNEINKLRINDHLIKRDIKDKMLHTLFMDHKSISANAMKKWLVKNQYFSNTDDIKIEGFQKENACSTSLTPWIDFTKIFGEINNSNYELIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPEMIRNKMFGFWNKLYENKIISPKKFYSLIKSEYSDKDKERFINRQIVETRQITKHVAQIISNHYETTKVVTVRADLSHAFRERYHIYKNRDINDFHHAHDAYIATILGTYIGHRFESLDAKYIYGEYQKIFRNKNKDKKDGFILNSMRNLYADKDTGEVVWDPEWISRIKKCFYYKDCFVTKKLEENNGSFFNTVRPNDEHSEKGAKVPVNKLRSNVHKYGGFEGLKYSIVAIKGKKKKGKKIIDVNKLVGIPLMYKNVDDETKINYIKESEGLEEVKIIKEILKNQLIEINGGLFYVTSEIVNARQLILDFNCTRIIDGIYKAMKYKNYSELSQEEIMNVYDIFVEKLKLYYPTYKNIATNFENFENISDEEKCEVIQMLVVMHAGPQNGNITFDDFKLSNRLGRLNCKTISLTTVFIADSPTGMYSKKYKL

SEQ ID NO: 327 - protein, 1301 aa, Kandleria vitulina
NNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRQKNKGKNDGFILNSMRNIYADKDTGEIVWDPNYIDRIKKCFYYKDCFVTKKLEENNGTFFNTVLPNDTNSDKDATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAEIINAKQLILNESQTKLVCEIYKAMKYKNYDNLDSEKIIDLYRLLINKMELYYPEYRKQLVKKFEDLKVISIEEKCNIIQILATLHCNSSIGKIMYSDFKISTTIGRLNGRTISLDISFIAESPTGMYSKKYKL

SEQ ID NO: 328 - protein, 1304 aa, Lactobacillus animalis
LKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMEDYSQNFMQLINDDTYSFKETIKNAQVIEKEETLAKTVQELPGSPAIKKGILQSLEIVDEIIKVMGYKPKSIVVEMARETQTHGTRKREDRVQQIVKNLKELPKPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 329 - protein, 1292 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKQTSLFNDRTDRAFYDDYPTIYHLRYKLMTEKRQFDIREIYLAMHHIVKYRGHFLNEAPVSSFKSSEINLVAHFDRLNTIFADLFSESGFTDKLAEVKALLLDNHQSASNRQRQALLLIYTPSKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGKSKEDFYGDITKALKNNPDHPIVSEIKKLIELDQFMPKQRTKDNGAIPHQLHQQELDRIIENQQQYYPWLAELNPNKLDELVAFRVPYYVGPLQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISELEIRNELKDLSNSALSNTRLFLYFMQGGRDMYTGDSLNIDRLSTYDIDHILPQSFIKDNSLDNRVLVSQRMNRSKADQVPSVELGQKMQIQWEQMLRAGLITKKKYDNLTLNPDMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKRNFNFLNGLKKDELVDENTEAVIWNKESGLAYLNKIYQFKKILVTREVHENSGALFNQTLYAAKDDKASGQLIPAKQDRPTALYGGYSGKTVAYMCIVRIKNKKGDLYKVCGVETSWLAQLKQKKAFLKQKISPQFTKVKKQKGTIVKVVEDFEVIAPHILINQRFFDNGQELTLGSHNEQELILDKTAVKLLNGALPLTQSEELAEQVYDEILDQVMHYFPLYDTNQFRAKLSAGKAADGNKMVQVGQQVILDRVLIGLHANAAVSDLGVLKISTPLGKMQQPSGISDTQIIYQSPTGLFERRVALRDL

SEQ ID NO: 330 - protein, 1291 aa, Lactobacillus farciminis
KEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKKKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNDLMWTTNNNFISIISNDKYDFKNYIENHNLNKNEDQNISNLVNDIHVSPALKRGITQSIKIVQEIVKFMGHAPKYIFIEVTRETKTTSRGKRIQRLQSKLLNKANGLVPEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALELVKNRNINDFHHAQDAYLASFLGTYRLRRFPTDEMLLMNGEYNKFYGKELYSKKSRKNGFIISPLVNGTTQDRNTGEIIWNVGFRDKILKIFNYHQCNVTRKTEIKTGQFYDQTIYSPKNPKKLIAQKKDMDPNIYGGFSGDNKSSITIVKIDNNKIKPVAIPIRLINDKKTLQNWLEENVKHKKSIQIIKNNVPIGQIIYSKKVGLLSREIANRQQLILPPEHSALLRILQIPDEDPDQILAFYDKNILVEILQELITKMKKFYPFYKNEQEFLASFNQATTSEKINSLEELITLLHANSTSAHLIFNNIEKKAFGRKTHGLTDTDFIYQSVTGLYETRIHIE

SEQ ID NO: 331 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 332 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 333 - protein, 1327 aa, Listeria innocua; identical to SEQ ID NO: 332

SEQ ID NO: 334 - protein, 1101 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 335 - protein, 1327 aa, Listeria ivanovii
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIERLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 336 - protein, 952 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 337 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 338 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 339 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 340 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 341 - protein, 1327 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 342 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 343 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFILTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 344 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVNDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYTFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKRIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 345 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 346 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 347 - protein, 1327 aa, Listeria monocytogenes; identical to SEQ ID NO: 342

SEQ ID NO: 348 - protein, 1327 aa, Listeria monocytogenes; identical to SEQ ID NO: 346

SEQ ID NO: 349 - protein, 781 aa, Listeria monocytogenes
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 350 - protein, 1327 aa, Listeria seeligeri
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIERIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 351 - protein, 1359 aa, synthetic construct; identical to SEQ ID NO: 325

SEQ ID NO: 352 - protein, 1290 aa, Roseburia hominis
IVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDVFTQFADFNNIPYEDDKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRKAPVDEFYKFVKKCIEKVDTPEAKQILHDIELENFLLKQNSRTNGSVPYQMQLDEMIKIIDNQAKYYPVLKEKREQLLSILTFRIPYYFGPLETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADSVTVLDVLESRLNLMEIINDKELGYAQMIEEASSCPKDGKFTYEEVAKLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQMFNTVLPNDAHSAKGAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSECVNAMQLVLNEEQCKLIADIYNAIYKQDFDGLDNMLMIQLYLQLIDKLKTLYPIYMGIVEKFEKFVSISKEEKANVIQMLIIMHKGPQNGNIIYDDFNVGKRIGRLNGRTFYLNIEFISQSPTGIYTKKYKL

SEQ ID NO: 353 - protein, 1292 aa, Sharpea azabuensis
KDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGDNYNLFIEKDFNDKTYYDKYPTIYHLRKELCENKEKADPRLIYLALHHIVKYRGNFLYEGQSFTMDNSDIEERLNSAIEKFMSINEFDNRIVSDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYDTPVEEFYKYIKGLLAKVDTDEAREILERIDLEKFMLKQNSRTNGSIPYQMQKDEMIQIIDNQSVYYPQLKENRDKLISILEFRIPYYFGPLAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADKATVLFVLESNKNLMEIINDEKLGYKQIIEESNMQDIEGPFKYDEVKKLAGSPAIKRGIWQALLVVREITKFMKHEPSHIYIEFAREEQKVRKESKIAKLQKIYENLQTQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKNYGFILNSMNHLQSDIDTGEVMWDPAKIGKIKSCFYYKDVYVTKKLEQNSGTLFNTVLPNDAHSEKGATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSEYVTARQLSLNEQSCKLISEIYAAMLKKRYEYLDEEEIFDLYLQLLQKMDTLYPAYKGIAKRFFDFKNIDVVEKCDVIQILIIMHAGPMNGNIMYDDFKFTNRIGRFTHKNIDLKTTFISTSVTGLFSKKYKL

SEQ ID NO: 354 - protein, 1359 aa, synthetic construct; identical to SEQ ID NO: 325

SEQ ID NO: 355 - protein, 1359 aa, synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 356 - protein, 1359 aa, synthetic construct; identical to SEQ ID NO: 108

SEQ ID NO: 357 - protein, 1359 aa, synthetic construct; identical to SEQ ID NO: 355

SEQ ID NO: 358 - DNA, 23 bp, synthetic construct
  source 1..23: mol_type = other DNA
agaaaaacaattttagtatttgg

SEQ ID NO: 359 - DNA, 23 bp, synthetic construct
  source 1..23: mol_type = other DNA
gcagaaatagactaattgcatgg

SEQ ID NO: 360 - DNA, 20 bp, synthetic construct
  source 1..20: mol_type = other DNA
gtcacccctgcgctgacagc

SEQ ID NO: 361 - DNA, 96 bp, synthetic construct
  source 1..96: mol_type = other DNA
cttcggcttcccctggagagagcgagattctccgcgctgtagaagtcatcattgttgtgcacgacgacatcattccgtggcgttatccagctaagc

SEQ ID NO: 362 - protein, 34 aa, synthetic construct
TSASPGESEILRAVEVIIVVHDDIIPWRWRYPAK

SEQ ID NO: 363 - DNA, 23 bp, synthetic construct
  source 1..23: mol_type = other DNA
gtaaacaaagcatagactgaggg

SEQ ID NO: 364 - DNA, 23 bp, synthetic construct
  source 1..23: mol_type = other DNA
gaagaccaaggatagactgctgg

SEQ ID NO: 365 - DNA, 23 bp, synthetic construct
  source 1..23: mol_type = other DNA
gttttgtttagtaactgacgtcc

SEQ ID NO: 366 - DNA, 23 bp, synthetic construct
  source 1..23: mol_type = other DNA
cttgtatttcttatcttactacc

SEQ ID NO: 367 - DNA, 23 bp, synthetic construct
  source 1..23: mol_type = other DNA
cttgtgtttcgtatctgacgccc

SEQ ID NO: 368 - DNA, 23 bp, synthetic construct
  source 1..23: mol_type = other DNA
gaatactaagcatagactccagg

SEQ ID NO: 369 - DNA, 23 bp, synthetic construct
  source 1..23: mol_type = other DNA
gaaaacaaatcattgactgcagg

SEQ ID NO: 370 - DNA, 23 bp, synthetic construct
  source 1..23: mol_type = other DNA
gaacataaagaatagaatgatgg

SEQ ID NO: 371 - protein, 183 aa, unidentified
  source 1..183: note = Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 372 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 373 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 374 - protein, 161 aa, unidentified
  source 1..161: note = Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 375 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 376 - protein, 1300 aa, unidentified
  source 1..1300: note = Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 377 - protein, 1300 aa, unidentified
  source 1..1300: note = Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 378 - protein, 1300 aa, unidentified
  source 1..1300: note = Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 379 - protein, 1300 aa, unidentified
  source 1..1300: note = Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 380 - protein, 1300 aa, unidentified
  source 1..1300: note = Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 381 - protein, 1300 aa, unidentified
  source 1..1300: note = Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 382 - protein, 1300 aa, unidentified
  source 1..1300: note = Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 383 - protein, 1300 aa, unidentified
  source 1..1300: note = Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 384 - protein, 24 aa, synthetic construct
SGGSSGSETPGTSESATPESSGGS

SEQ ID NO: 385 - protein, 32 aa, synthetic construct
SGGSSGGSSGSETPGTSESATPESSGGSSGGS

SEQ ID NO: 386 - protein, 104 aa, synthetic construct
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 387 - protein, 1782 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQAGGSPKKKRKV

SEQ ID NO: 388 - protein, 1785 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPGGSPKKKRKV

SEQ ID NO: 389 - RNA, 82 nt, synthetic construct
  source 1..82: mol_type = other RNA
gttttagagctagaaatagcaagttaaaataaaggctagtccgttatcaacttgaaaaagtggcaccgagtcggtgcttttt

SEQ ID NO: 390 - DNA, 20 bp, synthetic construct
  source 1..20: mol_type = other DNA
gaacacaaagcatagactgc

SEQ ID NO: 391 - DNA, 20 bp, synthetic construct
  source 1..20: mol_type = other DNA
ggaacacaaagcatagactg

SEQ ID NO: 392 - DNA, 20 bp, synthetic construct
  source 1..20: mol_type = other DNA
aacacaaagcatagactgcg

SEQ ID NO: 393 - DNA, 20 bp, synthetic construct
  source 1..20: mol_type = other DNA
acaaagcatagactgcgggg

SEQ ID NO: 394 - DNA, 20 bp, synthetic construct
  source 1..20: mol_type = other DNA
caaagcatagactgcggggc

SEQ ID NO: 395 - DNA, 20 bp, synthetic construct
  source 1..20: mol_type = other DNA
gtggtaattttccagcccgc

SEQ ID NO: 396 - DNA, 20 bp, synthetic construct
  source 1..20: mol_type = other DNA
cctttacagggccagcgggc

SEQ ID NO: 397 - DNA, 20 bp, synthetic construct
  source 1..20: mol_type = other DNA
ctgtcacagttagctcagcc

SEQ ID NO: 398 - DNA, 20 bp, synthetic construct
  source 1..20: mol_type = other DNA
gtgttccagtttcctttaca

SEQ ID NO: 399 - DNA, 20 bp, synthetic construct
  source 1..20: mol_type = other DNA
gaacacaatgcatagattgc

SEQ ID NO: 400 - DNA, 20 bp, synthetic construct
  source 1..20: mol_type = other DNA
gaaaaaaaagcagagactgc

SEQ ID NO: 401 - DNA, 20 bp, synthetic construct
  source 1..20: mol_type = other DNA
gaatactaagcatagactcc

SEQ ID NO: 402 - DNA, 20 bp, synthetic construct
  source 1..20: mol_type = other DNA
gtaaacaaagcatagactga

SEQ ID NO: 403 - DNA, 20 bp, synthetic construct
  source 1..20: mol_type = other DNA
ggacacaaagcttagactcc

SEQ ID NO: 404 - DNA, 20 bp, synthetic construct
  source 1..20: mol_type = other DNA
caatacaaaggatagactgc

SEQ ID NO: 405 - DNA, 20 bp, synthetic construct
  source 1..20: mol_type = other DNA
gaagaccaaggatagactgc

SEQ ID NO: 406 - DNA, 20 bp, synthetic construct
  source 1..20: mol_type = other DNA
gaaaacaaatcattgactgc

SEQ ID NO: 407 - DNA, 20 bp, synthetic construct
  source 1..20: mol_type = other DNA
gatcacaaagcatggactga

SEQ ID NO: 408 - DNA, 20 bp, synthetic construct
  source 1..20: mol_type = other DNA
gaaaacaaaacatagagtgc

SEQ ID NO: 409 - DNA, 20 bp, synthetic construct
  source 1..20: mol_type = other DNA
gaacataaagaatagaatga

SEQ ID NO: 410 - DNA, 20 bp, synthetic construct
  source 1..20: mol_type = other DNA
gagtccgagcagaagaagaa

SEQ ID NO: 411 - DNA, 20 bp, synthetic construct
  source 1..20: mol_type = other DNA
ggaatcccttctgcagcacc

SEQ ID NO: 412 - DNA, 20 bp, synthetic construct
  source 1..20: mol_type = other DNA
gaacacaaagcatagactgc

SEQ ID NO: 413 - DNA, 20 bp, synthetic construct
  source 1..20: mol_type = other DNA
ggcccagactgagcacgtga

SEQ ID NO: 414 - DNA, 20 bp, synthetic construct
  source 1..20: mol_type = other DNA
ggcactgcggctggaggtcc

SEQ ID NO: 415 - DNA, 20 bp, synthetic construct
  source 1..20: mol_type = other DNA
gtcatcttagtcattacctg

SEQ ID NO: 416 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 417 - protein, 345 aa, unidentified
  source 1..345: note = Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 418 - protein, 345 aa, unidentified
  source 1..345: note = Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 419 - protein, 1210 aa, unidentified
  source 1..1210: note = Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 420 - protein, 166 aa, synthetic construct
SEVEFSHEYWMRHALTLAKRAWDAGEVPVGAVLVHNNRVIGEGWNRPIGRHDPTAHAEIMALRQGGLVMQNYRLIDATLYVTFEPCVMCAGAMIHSRIGRVVFGVNNAKTGAAGSLMDVLHYPGMNHRVEITEGILADECNELLSYFFRMRRQVFKAQKKAQSSTD

SEQ ID NO: 421 - protein, 166 aa, synthetic construct; identical to SEQ ID NO: 73

SEQ ID NO: 422 - protein, 166 aa, synthetic construct
SEVEFSHEYWMRHALTLAKRAWDEREVPVGAVLVHTNRVIGEGWNRTIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 423 - protein, 166 aa, synthetic construct
SEVEFSHEYWMRHALTLAKRAWDEREVPVGAVLVHSNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 424 - protein, 166 aa, synthetic construct
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 425 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLRYFFRMRRQVFKAQKKAQSSTD

SEQ ID NO: 426 - protein, 166 aa, synthetic construct
SEVEFSHEYWMRHALTLAKRAWDEREVPVGAVLVLNNRVIGEGWNRLIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 427 - protein, 166 aa, synthetic construct
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 428 - protein, 166 aa, synthetic construct
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFKAQKKAQSSTD

SEQ ID NO: 429 - protein, 166 aa, synthetic construct; identical to SEQ ID NO: 425

SEQ ID NO: 430 - protein, 166 aa, synthetic construct
SEVEFSHEYWMRHALTLAKRAWDEREVPVGAVLVHSNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 431 - protein, 166 aa, synthetic construct
SEVEFSHEYWMRHALTLAKRAWDEREVPVGAVLVHNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 432 - protein, 166 aa, synthetic construct
SEVEFSHEYWMRHALTLAKRAWDEREVPVGAVLVHNNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 433 - protein, 159 aa, synthetic construct
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADNPKGGCSGSLMNLLQQSNFNHRAIVDKGVLKEACSTLLTTFFKNLRANKKSTN

SEQ ID NO: 434 - protein, 159 aa, synthetic construct
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACSTLLTTFFKNLRANKKSTN

SEQ ID NO: 435 - protein, 159 aa, synthetic construct
GSHMTNDIYFMTLAIEEAKKAAQLPEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACSTLLTTFFKNLRANKKSTN

SEQ ID NO: 436 - protein, 159 aa, synthetic construct
GSHMTNDIYFMTLAIEEAKKAAQLPEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACATLLTTFFKNLRANKKSTN

SEQ ID NO: 437 - protein, 159 aa, synthetic construct
GSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGAANPKGGCSGSLMNLLQQSNFNHRAIVDKGVLKEACATLLTTFFKNLRANKKSTN

SEQ ID NO: 438 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 439 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 440 - protein, 1774 aa, synthetic construct
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 441 - DNA, 20 bp, synthetic construct
  source 1..20: mol_type = other DNA
tacggcgtagtgcacctgga

SEQ ID NO: 442 - DNA, 20 bp, synthetic construct
  source 1..20: mol_type = other DNA
atcttattcgatcatgcgaa

SEQ ID NO: 443 - DNA, 20 bp, synthetic construct
  source 1..20: mol_type = other DNA
gcttaggtggagcgcctatt

SEQ ID NO: 444 - DNA, 20 bp, synthetic construct
  source 1..20: mol_type = other DNA
caatgatgacttctacagcg

SEQ ID NO: 445 - DNA, 20 bp, synthetic construct
  source 1..20: mol_type = other DNA
gaacacaaagcatagactgc

SEQ ID NO: 446 - DNA, 20 bp, synthetic construct
  source 1..20: mol_type = other DNA
ggaacacaaagcatagactg

SEQ ID NO: 447 - DNA, 20 bp, synthetic construct
  source 1..20: mol_type = other DNA
aacacaaagcatagactgcg

SEQ ID NO: 448 - DNA, 20 bp, synthetic construct
  source 1..20: mol_type = other DNA
acaaagcatagactgcgggg

SEQ ID NO: 449 - DNA, 20 bp, synthetic construct
  source 1..20: mol_type = other DNA
caaagcatagactgcggggc

SEQ ID NO: 450 - DNA, 20 bp, synthetic construct
  source 1..20: mol_type = other DNA
gtggtaattttccagcccgc

SEQ ID NO: 451 - DNA, 20 bp, synthetic construct
  source 1..20: mol_type = other DNA
cctttacagggccagcgggc

SEQ ID NO: 452 - DNA, 20 bp, synthetic construct
  source 1..20: mol_type = other DNA
ctgtcacagttagctcagcc

SEQ ID NO: 453 - DNA, 20 bp, synthetic construct
  source 1..20: mol_type = other DNA
gtgttccagtttcctttaca

SEQ ID NO: 454 - DNA, 20 bp, synthetic construct
  source 1..20: mol_type = other DNA
gaacacaatgcatagattgc

SEQ ID NO: 455 - DNA, 20 bp, synthetic construct
  source 1..20: mol_type = other DNA
gaaaaaaaagcagagactgc

SEQ ID NO: 456 - DNA, 20 bp, synthetic construct
  source 1..20: mol_type = other DNA
gaatactaagcatagactcc

SEQ ID NO: 457 - DNA, 20 bp, synthetic construct
  source 1..20: mol_type = other DNA
gtaaacaaagcatagactga

SEQ ID NO: 458 - DNA, 20 bp, synthetic construct
  source 1..20: mol_type = other DNA
ggacacaaagcttagactcc

SEQ ID NO: 459 - DNA, 20 bp, synthetic construct
  source 1..20: mol_type = other DNA
caatacaaaggatagactgc

SEQ ID NO: 460 - DNA, 20 bp, synthetic construct
  source 1..20: mol_type = other DNA
gaagaccaaggatagactgc

SEQ ID NO: 461 - DNA, 20 bp, synthetic construct
  source 1..20: mol_type = other DNA
gaaaacaaatcattgactgc

SEQ ID NO: 462 - DNA, 20 bp, synthetic construct
  source 1..20: mol_type = other DNA
gatcacaaagcatggactga

SEQ ID NO: 463 - DNA, 20 bp, synthetic construct
  source 1..20: mol_type = other DNA
gaaaacaaaacatagagtgc

SEQ ID NO: 464 - DNA, 20 bp, synthetic construct
  source 1..20: mol_type = other DNA
gaacataaagaatagaatga

SEQ ID NO: 465 - DNA, 23 bp, synthetic construct
  source 1..23: mol_type = other DNA
gaaaaaaaagcagagactgctgg

SEQ ID NO: 466 - DNA, 23 bp, synthetic construct
  source 1..23: mol_type = other DNA
ggacacaaagcttagactccagg

SEQ ID NO: 467 - DNA, 23 bp, synthetic construct
  source 1..23: mol_type = other DNA
gaaaacaaaacatagagtgctgg

SEQ ID NO: 468 - DNA, 23 bp, synthetic construct
  source 1..23: mol_type = other DNA
gtcatcttagtcattacctgagg

SEQ ID NO: 469 - DNA, 23 bp, synthetic construct
  source 1..23: mol_type = other DNA
gaagatagagaatagactgctgg

SEQ ID NO: 470 - DNA, 23 bp, synthetic construct
  source 1..23: mol_type = other DNA
ggctaaagaccatagactgtggg

SEQ ID NO: 471 - DNA, 23 bp, synthetic construct
  source 1..23: mol_type = other DNA
gagtatgaggcatagactgcagg

SEQ ID NO: 472 - DNA, 23 bp, synthetic construct
  source 1..23: mol_type = other DNA
gtcaagaaagcagagactgccgg

SEQ ID NO: 473 - DNA, 23 bp, synthetic construct
  source 1..23: mol_type = other DNA
gacaaagaggaagagagacgggg

SEQ ID NO: 474 - DNA, 23 bp, synthetic construct
  source 1..23: mol_type = other DNA
gcctaggcagtgggggtgcaggg

SEQ ID NO: 475 - DNA, 23 bp, synthetic construct
  source 1..23: mol_type = other DNA
ggggacgcgctggcttcccgggg

SEQ ID NO: 476 - DNA, 20 bp, synthetic construct
  source 1..20: mol_type = other DNA
agaaaaacaattttagtatt

SEQ ID NO: 477 - DNA, 20 bp, synthetic construct
  source 1..20: mol_type = other DNA
gcagaaatagactaattgca

SEQ ID NO: 478 - DNA, 20 bp, synthetic construct
  source 1..20: mol_type = other DNA
gaacacaaagcatagactgc

SEQ ID NO: 479 - DNA, 20 bp, synthetic construct
  source 1..20: mol_type = other DNA
gaacacaatgcatagattgc

SEQ ID NO: 480 - DNA, 20 bp, synthetic construct
  source 1..20: mol_type = other DNA
ggaacacaaagcatagactg

SEQ ID NO: 481 - DNA, 20 bp, synthetic construct
  source 1..20: mol_type = other DNA
aacacaaagcatagactgcg

SEQ ID NO: 482 - DNA, 20 bp, synthetic construct
  source 1..20: mol_type = other DNA
acaaagcatagactgcgggg

SEQ ID NO: 483 - DNA, 20 bp, synthetic construct
  source 1..20: mol_type = other DNA
caaagcatagactgcggggc

SEQ ID NO: 484 - DNA, 20 bp, synthetic construct
  source 1..20: mol_type = other DNA
gtggtaattttccagcccgc

SEQ ID NO: 485 - DNA, 20 bp, synthetic construct
  source 1..20: mol_type = other DNA
cctttacagggccagcgggc

SEQ ID NO: 486 - DNA, 20 bp, synthetic construct
  source 1..20: mol_type = other DNA
ctgtcacagttagctcagcc

SEQ ID NO: 487 - DNA, 20 bp, synthetic construct
  source 1..20: mol_type = other DNA
gtgttccagtttcctttaca

SEQ ID NO: 488 - DNA, 20 bp, synthetic construct
  source 1..20: mol_type = other DNA
gaaaaaaaagcagagactgc

SEQ ID NO: 489 - DNA, 20 bp, synthetic construct
  source 1..20: mol_type = other DNA
gaatactaagcatagactcc

SEQ ID NO: 490 - DNA, 20 bp, synthetic construct
  source 1..20: mol_type = other DNA
gtaaacaaagcatagactga

SEQ ID NO: 491 - DNA, 20 bp, synthetic construct
  source 1..20: mol_type = other DNA
ggacacaaagcttagactcc

SEQ ID NO: 492 - DNA, 20 bp, synthetic construct
  source 1..20: mol_type = other DNA
caatacaaaggatagactgc

SEQ ID NO: 493 - DNA, 20 bp, synthetic construct
  source 1..20: mol_type = other DNA
gaagaccaaggatagactgc

SEQ ID NO: 494 - DNA, 20 bp, synthetic construct
  source 1..20: mol_type = other DNA
gaaaacaaatcattgactgc

SEQ ID NO: 495 - DNA, 20 bp, synthetic construct
  source 1..20: mol_type = other DNA
gatcacaaagcatggactga

SEQ ID NO: 496 - DNA, 20 bp, synthetic construct
  source 1..20: mol_type = other DNA
gaaaacaaaacatagagtgc

SEQ ID NO: 497 - DNA, 20 bp, synthetic construct
  source 1..20: mol_type = other DNA
gaacataaagaatagaatga

SEQ ID NO: 498 - DNA, 20 bp, synthetic construct
  source 1..20: mol_type = other DNA
aatcaagataaggctcttag

SEQ ID NO: 499 - DNA, 21 bp, synthetic construct
  source 1..21: mol_type = other DNA
gctcaccctctaaagctgaaa

SEQ ID NO: 500 - DNA, 21 bp, synthetic construct
  source 1..21: mol_type = other DNA
gtatatgcatatttattacat

SEQ ID NO: 501 - DNA, 21 bp, synthetic construct
  source 1..21: mol_type = other DNA
gcagctacacagggcaggtct

SEQ ID NO: 502 - DNA, 21 bp, synthetic construct
  source 1..21: mol_type = other DNA
gacctcacttagtgctccctg

SEQ ID NO: 503 - DNA, 20 bp, synthetic construct
  source 1..20: mol_type = other DNA
ggacaggcagcatagactgt

SEQ ID NO: 504 - DNA, 20 bp, synthetic construct
  source 1..20: mol_type = other DNA
gtagaaaaagtatagactgc

SEQ ID NO: 505 - DNA, 20 bp, synthetic construct
  source 1..20: mol_type = other DNA
ggagagagagcatagactgc

SEQ ID NO: 506 - DNA, 20 bp, synthetic construct
  source 1..20: mol_type = other DNA
gaagatagagaatagactgc

SEQ ID NO: 507 - DNA, 20 bp, synthetic construct
  source 1..20: mol_type = other DNA
ggctaaagaccatagactgt

SEQ ID NO: 508 - DNA, 20 bp, synthetic construct
  source 1..20: mol_type = other DNA
gtctagaaagcttagactgc

SEQ ID NO: 509 - DNA, 20 bp, synthetic construct
  source 1..20: mol_type = other DNA
gagtatgaggcatagactgc

SEQ ID NO: 510 - DNA, 20 bp, synthetic construct
  source 1..20: mol_type = other DNA
gtcaagaaagcagagactgc

SEQ ID NO: 511 - DNA, 20 bp, synthetic construct
  source 1..20: mol_type = other DNA
gggaataaatcatagaatcc

SEQ ID NO: 512 - DNA, 20 bp, synthetic construct
  source 1..20: mol_type = other DNA
gagcaaagacaatacactgt

SEQ ID NO: 513 - DNA, 20 bp, synthetic construct
  source 1..20: mol_type = other DNA
gacaaagaggaagagagacg

SEQ ID NO: 514 - DNA, 20 bp, synthetic construct
  source 1..20: mol_type = other DNA
ggggacgcgctggcttcccg

SEQ ID NO: 515 - DNA, 20 bp, synthetic construct
  source 1..20: mol_type = other DNA
ggaccggctccctggcggtc

SEQ ID NO: 516 - DNA, 20 bp, synthetic construct
  source 1..20: mol_type = other DNA
gccacttctaagcccttgat

SEQ ID NO: 517 - DNA, 20 bp, synthetic construct
  source 1..20: mol_type = other DNA
gggaaagacccagcatccgt

SEQ ID NO: 518 - DNA, 20 bp, synthetic construct
  source 1..20: mol_type = other DNA
gcggtacgccgcttcagtga

SEQ ID NO: 519 - DNA, 20 bp, synthetic construct
  source 1..20: mol_type = other DNA
gaaactggtcccgtttacag

SEQ ID NO: 520 - DNA, 20 bp, synthetic construct
  source 1..20: mol_type = other DNA
gatgagataatgatgagtca

SEQ ID NO: 521 - DNA, 20 bp, synthetic construct
  source 1..20: mol_type = other DNA
gcctaggcagtgggggtgca

SEQ ID NO: 522 - DNA, 21 bp, synthetic construct
  source 1..21: mol_type = other DNA
gactcagataagatgctgagg

SEQ ID NO: 523 - DNA, 21 bp, synthetic construct
  source 1..21: mol_type = other DNA
gcatatgtaacagttcctgca

SEQ ID NO: 524 - DNA, 20 bp, synthetic construct
  source 1..20: mol_type = other DNA
gtgcatgtttgtgcctgtcc

SEQ ID NO: 525 - DNA, 20 bp, synthetic construct
  source 1..20: mol_type = other DNA
ggggatggcagggcaggaag

SEQ ID NO: 526 - DNA, 20 bp, synthetic construct
  source 1..20: mol_type = other DNA
gggttaggggccccaggccg

SEQ ID NO: 527 - DNA, 20 bp, synthetic construct
  source 1..20: mol_type = other DNA
ggatgcagctcgttaccacc

SEQ ID NO: 528 - DNA, 20 bp, synthetic construct
  source 1..20: mol_type = other DNA
gcgcacggtggcggggtccc

SEQ ID NO: 529 - DNA, 20 bp, synthetic construct
  source 1..20: mol_type = other DNA
gggccaggtccctcctctcc

SEQ ID NO: 530 - DNA, 20 bp, synthetic construct
  source 1..20: mol_type = other DNA
ggattgacccaggccagggc

SEQ ID NO: 531 - DNA, 20 bp, synthetic construct
  source 1..20: mol_type = other DNA
gatgacaggcaggggcaccg

SEQ ID NO: 532 - DNA, 20 bp, synthetic construct
  source 1..20: mol_type = other DNA
gggccagtgaaatcaccctg

SEQ ID NO: 533 - DNA, 20 bp, synthetic construct
  source 1..20: mol_type = other DNA
ggggactttgggaggtgatc

SEQ ID NO: 534 - DNA, 20 bp, synthetic construct
  source 1..20: mol_type = other DNA
gcaccagcagatgcagtgtc

SEQ ID NO: 535 - DNA, 21 bp, synthetic construct
  source 1..21: mol_type = other DNA
gacacacacacttagaatctg

SEQ ID NO: 536 - DNA, 21 bp, synthetic construct
  source 1..21: mol_type = other DNA
gcacacacacttagaatctgt

SEQ ID NO: 537 - DNA, 23 bp, synthetic construct
  source 1..23: mol_type = other DNA
gaacacaaagcatagactgctgg

SEQ ID NO: 538 - DNA, 23 bp, synthetic construct
  source 1..23: mol_type = other DNA
gaaaaaaaagcagagactgctgg

SEQ ID NO: 539 - DNA, 23 bp, synthetic construct
  source 1..23: mol_type = other DNA
gaatactaagcatagactccagg

SEQ ID NO: 540 - DNA, 23 bp, synthetic construct
  source 1..23: mol_type = other DNA
gtaaacaaagcatagactgaggg

SEQ ID NO: 541 - DNA, 23 bp, synthetic construct
  source 1..23: mol_type = other DNA
gaagaccaaggatagactgctgg

SEQ ID NO: 542 - DNA, 23 bp, synthetic construct
  source 1..23: mol_type = other DNA
gaacataaagaatagaatgatgg

SEQ ID NO: 543 - DNA, 23 bp, synthetic construct
  source 1..23: mol_type = other DNA
ggacaggcagcatagactgtggg

SEQ ID NO: 544 - DNA, 23 bp, synthetic construct
  source 1..23: mol_type = other DNA
gtagaaaaagtatagactgcagg

SEQ ID NO: 545 - DNA, 23 bp, synthetic construct
  source 1..23: mol_type = other DNA
ggagagagagcatagactgctgg

SEQ ID NO: 546 - DNA, 23 bp, synthetic construct
  source 1..23: mol_type = other DNA
gaagatagagaatagactgctgg

SEQ ID NO: 547 - DNA, 23 bp, synthetic construct
  source 1..23: mol_type = other DNA
ggctaaagaccatagactgtggg

SEQ ID NO: 548 - DNA, 23 bp, synthetic construct
  source 1..23: mol_type = other DNA
gtctagaaagcttagactgctgg

SEQ ID NO: 549 - DNA, 23 bp, synthetic construct
  source 1..23: mol_type = other DNA
gagtatgaggcatagactgcagg

SEQ ID NO: 550 - DNA, 23 bp, synthetic construct
  source 1..23: mol_type = other DNA
gtcaagaaagcagagactgccgg

SEQ ID NO: 551 - DNA, 23 bp, synthetic construct
  source 1..23: mol_type = other DNA
gggaataaatcatagaatcctgg

SEQ ID NO: 552 - DNA, 23 bp, synthetic construct
  source 1..23: mol_type = other DNA
gagcaaagagaatagactgtagg

SEQ ID NO: 553 - DNA, 20 bp, synthetic construct
  source 1..20: mol_type = other DNA
gaacacaaagcatagactgc

SEQ ID NO: 554 - DNA, 20 bp, synthetic construct
  source 1..20: mol_type = other DNA
ggacaggcagcatagactgt

SEQ ID NO: 555 - DNA, 20 bp, synthetic construct
  source 1..20: mol_type = other DNA
gaagatagagaatagactgc

SEQ ID NO: 556 - DNA, 20 bp, synthetic construct
  source 1..20: mol_type = other DNA
gcctaggcagtgggggtgca

SEQ ID NO: 557 - DNA, 20 bp, synthetic construct
  source 1..20: mol_type = other DNA
gacaaagaggaagagagacg

SEQ ID NO: 558 - DNA, 20 bp, synthetic construct
  source 1..20: mol_type = other DNA
ggagagagagcatagactgc

SEQ ID NO: 559 - DNA, 20 bp, synthetic construct
  source 1..20: mol_type = other DNA
ggctaaagaccatagactgt

SEQ ID NO: 560 - DNA, 20 bp, synthetic construct
  source 1..20: mol_type = other DNA
gagtatgaggcatagactgc

SEQ ID NO: 561 - DNA, 23 bp, synthetic construct
  source 1..23: mol_type = other DNA
gatgagataatgatgagtcaggg

SEQ ID NO: 562 - DNA, 23 bp, synthetic construct
  source 1..23: mol_type = other DNA
acacacacacttagaatctctgg

SEQ ID NO: 563 - DNA, 23 bp, synthetic construct
  source 1..23: mol_type = other DNA
cacacacacttagaatctgtggg

SEQ ID NO: 564 - DNA, 23 bp, synthetic construct
  source 1..23: mol_type = other DNA
gtctagaaagcttagactgctgg

SEQ ID NO: 565 - DNA, 20 bp, synthetic construct
  source 1..20: mol_type = other DNA
ttcattaactgtggccggct

SEQ ID NO: 566 - DNA, 20 bp, synthetic construct
  source 1..20: mol_type = other DNA
atcttattcgatcatgcgaa

SEQ ID NO: 567 - DNA, 23 bp, synthetic construct
  source 1..23: mol_type = other DNA
gagcaaagagaatagactgtagg

SEQ ID NO: 568 - DNA, 23 bp, synthetic construct
  source 1..23: mol_type = other DNA
gtctagaaagcttagactgctgg

SEQ ID NO: 569 - DNA, 23 bp, synthetic construct
  source 1..23: mol_type = other DNA
ggggactttgggaggtgatcagg

SEQ ID NO: 570 - DNA, 23 bp, synthetic construct
  source 1..23: mol_type = other DNA
tacggcgtagtgcacctggatgg

SEQ ID NO: 571 - DNA, 23 bp, synthetic construct
  source 1..23: mol_type = other DNA
gaacacaatgcatagattgctgg

SEQ ID NO: 572 - DNA, 23 bp, synthetic construct
  source 1..23: mol_type = other DNA
gatcacaaagcatggactgaagg

SEQ ID NO: 573 - DNA, 23 bp, synthetic construct
  source 1..23: mol_type = other DNA
gaacacaaagcatagactgcggg

SEQ ID NO: 574 - DNA, 23 bp, synthetic construct
  source 1..23: mol_type = other DNA
gaaaaaaaagcagagactgctgg

SEQ ID NO: 575 - DNA, 23 bp, synthetic construct
  source 1..23: mol_type = other DNA
gaatactaagcatagactccagg

SEQ ID NO: 576 - DNA, 23 bp, synthetic construct
  source 1..23: mol_type = other DNA
gtaaacaaagcatagactgaggg

SEQ ID NO: 577 - DNA, 23 bp, synthetic construct
  source 1..23: mol_type = other DNA
gaagaccaaggatagactgctgg

SEQ ID NO: 578 - DNA, 23 bp, synthetic construct
  source 1..23: mol_type = other DNA
gaacataaagaatagaatgatgg

SEQ ID NO: 579 - DNA, 23 bp, synthetic construct
  source 1..23: mol_type = other DNA
ggagagagagcatagactgctgg

SEQ ID NO: 580 - DNA, 23 bp, synthetic construct
  source 1..23: mol_type = other DNA
gaagatagagaatagactgctgg

SEQ ID NO: 581 - DNA, 23 bp, synthetic construct
  source 1..23: mol_type = other DNA
gtagaaaaagtatagactgcagg

SEQ ID NO: 582 - DNA, 23 bp, synthetic construct
  source 1..23: mol_type = other DNA
gtcaagaaagcagagactgccgg

SEQ ID NO: 583 - DNA, 23 bp, synthetic construct
  source 1..23: mol_type = other DNA
gagtatgaggcatagactgcagg

SEQ ID NO: 584 - DNA, 23 bp, synthetic construct
  source 1..23: mol_type = other DNA
gtctagaaagcttagactgctgg

SEQ ID NO: 585 - DNA, 23 bp, synthetic construct
  source 1..23: mol_type = other DNA
ggacaggcagcatagactgtggg

SEQ ID NO: 586 - DNA, 23 bp, synthetic construct
  source 1..23: mol_type = other DNA
gagcaaagagaatagactgtagg

SEQ ID NO: 587 - DNA, 23 bp, synthetic construct
  source 1..23: mol_type = other DNA
ggctaaagaccatagactgtggg

SEQ ID NO: 588 - DNA, 23 bp, synthetic construct
  source 1..23: mol_type = other DNA
gggaataaatcatagaatcctgg

SEQ ID NO: 589 - DNA, 197 bp, synthetic construct
  source 1..197: mol_type = other DNA
atcgacgccacgttgtatgtcacgcttgaaccatgtgtaatgtgtgccggagcgatgatccacagtcgcattggtcgcgtggtctttggtgcgcgtgacgcgaaaactggcgctgcgggatctttaatggatgtgctgcatcatccgggtatgaatcaccgagtggaaattacggaaggaatactggcggatgagtg

SEQ ID NO: 590 - protein, 66 aa, synthetic construct
IDATLYVTLEPCVMCAGAMIHSRIGRVVFGARDAKTGAAGSLMDVLHHPGMNHRVEITEGILADEC

SEQ ID NO: 591 - DNA, 197 bp, synthetic construct; identical to SEQ ID NO: 589
  source 1..197: mol_type = other DNA

SEQ ID NO: 592 - protein, 66 aa, synthetic construct; identical to SEQ ID NO: 590

SEQ ID NO: 593 - DNA, 197 bp, synthetic construct
  source 1..197: mol_type = other DNA
atcgacgccacgttgtatgtcacgcttgaaccatgtgtaatgtgtgccggagcgatgatccacagtcgcattggtcgcgtggtctttggtgcgtgtgacgcgaaaactggcgctgcgggatctttaatggatgtgctgcatcatccgggtatgaatcaccgagtggaaattacggaaggaatactggcggatgagtg

SEQ ID NO: 594 - protein, 66 aa, synthetic construct
IDATLYVTLEPCVMCAGAMIHSRIGRVVFGACDAKTGAAGSLMDVLHHPGMNHRVEITEGILADEC

SEQ ID NO: 595 - DNA, 197 bp, synthetic construct
  source 1..197: mol_type = other DNA
atcgacgccacgttgtatgtcacgcttgaaccatgtgtaatgtgtgccggagcgatgatccacagtcgcattggtcgcgtggtctttggtgcgcgtaacgcgaaaactggcgctgcgggatctttaatggatgtgctgcatcatccgggtatgagtcaccgagtggaaattacggaaggaatactggcggatgagtg

SEQ ID NO: 596 - protein, 66 aa, synthetic construct
IDATLYVTLEPCVMCAGAMIHSRIGRVVFGARNAKTGAAGSLMDVLHHPGMSHRVEITEGILADEC

SEQ ID NO: 597 - DNA, 197 bp, synthetic construct
  source 1..197: mol_type = other DNA
atcgacgccacgttgtatgtcacgcttgaaccatgtgtaatgtgtgccggagcgatgatccacagtcgcattggtcgcgtggtctttggtgcgcgtggcgcgaaaactggcgctgcgggatctttaatggatgtgctgcatcatccgggtatgaatcaccgagtggaaattacggaaggaatactggcggatgagtg

SEQ ID NO: 598 - protein, 66 aa, synthetic construct
IDATLYVTLEPCVMCAGAMIHSRIGRVVFGARGAKTGAAGSLMDVLHHPGMNHRVEITEGILADEC

SEQ ID NO: 599 - DNA, 197 bp, synthetic construct; identical to SEQ ID NO: 597
  source 1..197: mol_type = other DNA

SEQ ID NO: 600 - protein, 66 aa, synthetic construct; identical to SEQ ID NO: 598

SEQ ID NO: 601 - DNA, 197 bp, synthetic construct
  source 1..197: mol_type = other DNA
atcgacgccacgttgtatgtcacgcttgaaccatgtgtaatgtgtgccggagcgatgatccacagtcgcattggtcgcgtggtctttggtgtgcgtaacgcgaaaactggcgctgcgggatctttaatggatgtgctgcatcatccgggtatgaatcaccgagtggaaattacggagggaatactggcggatgagtg

SEQ ID NO: 602 - protein, 66 aa, synthetic construct
IDATLYVTLEPCVMCAGAMIHSRIGRVVFGVRNAKTGAAGSLMDVLHHPGMNHRVEITEGILADEC

SEQ ID NO: 603 - DNA, 197 bp, synthetic construct; identical to SEQ ID NO: 597
  source 1..197: mol_type = other DNA

SEQ ID NO: 604 - protein, 66 aa, synthetic construct; identical to SEQ ID NO: 598

SEQ ID NO: 605 - DNA, 197 bp, synthetic construct; identical to SEQ ID NO: 601
  source 1..197: mol_type = other DNA

SEQ ID NO: 606 - protein, 66 aa, synthetic construct; identical to SEQ ID NO: 602

SEQ ID NO: 607 - DNA, 197 bp, synthetic construct; identical to SEQ ID NO: 597
  source 1..197: mol_type = other DNA

SEQ ID NO: 608 - DNA, 192 bp, synthetic construct
  source 1..192: mol_type = other DNA
accgagtggaaattacggaaggaatactggcggatgagtgcgcggcgttgctcagtgacttctttcgcatgcgccgccaggwaattaaagcgcagaaaaaagcgcaatcctcgacggattccggtagcgaaacaccggggacttcagaatcggccaccccggagtctgataagaaatactcaataggcttag

SEQ ID NO: 609 - protein, 65 aa, synthetic construct
HRVEITEGILADECAALLSDFFRMRRQEVIKAQKKAQSSTDSGSETPGTSESATPESDKKYSIGL

SEQ ID NO: 610 - DNA, 192 bp, synthetic construct
  source 1..192: mol_type = other DNA
accgagtggaaattacggaaggaatactggcggatgagtgcgcggcgttgctcagtgacttctttcgcatgcgccgccaggaaattaaagcgcagaaaaaagcgcaatcctcgacggattccggtagcgaaacaccggggacttcagaatcggccaccccggagtctgataagaaatactcaataggcttag

SEQ ID NO: 611 - protein, 64 aa, synthetic construct
HRVEITEGILADECAALLSDFFRMRRQEIKAQKKAQSSTDSGSETPGTSESATPESDKKYSIGL

SEQ ID NO: 612 - DNA, 192 bp, synthetic construct
  source 1..192: mol_type = other DNA
accgagtggaaattacggaaggaatactggctgatgagtgcgcggcgttgctcagtgacttctttcgcatgcgccgccaggatattaaagcgcagaaacaagcgcaatcctcgacggattccggtagcgaaacaccggggacttcagaatcggccaccccggagtctgataagaaatactcaataggcttag

SEQ ID NO: 613 - protein, 64 aa, synthetic construct
HRVEITEGILADECAALLSDFFRMRRQDIKAQKQAQSSTDSGSETPGTSESATPESDKKYSIGL

SEQ ID NO: 614 - DNA, 192 bp, synthetic construct
  source 1..192: mol_type = other DNA
accgagtggaaattacagaaggaatactggcggatgagtgcgcggcgttgctcagtgacttctttcgcatgtgccgccatgaaattaaagcgcagaaaaaagcgcaatcctcgacggattccggtagcgaaacaccggggacttcagaatcggccaccccggagtctgataagaaatactcaataggcttag

SEQ ID NO: 615 - protein, 64 aa, synthetic construct
HRVEITEGILADECAALLSDFFRMCRHEIKAQKKAQSSTDSGSETPGTSESATPESDKKYSIGL

SEQ ID NO: 616 - DNA, 192 bp, synthetic construct
  source 1..192: mol_type = other DNA
accgagtggaaattacggaaggaatactggcggatgagtgcgcggcgttgctcagtgacttctttcgcatgcgccgccggggaattaaagcgcagaaaaaagcgcattcctcgacggattccggtagcgaaacaccggggacttcagaatcggccaccccggagtctgataagaaatactcaataggcttag

SEQ ID NO: 617 - protein, 64 aa, synthetic construct
HRVEITEGILADECAALLSDFFRMRRRGIKAQKKAHSSTDSGSETPGTSESATPESDKKYSIGL

SEQ ID NO: 618 - DNA, 192 bp, synthetic construct; identical to SEQ ID NO: 612
  source 1..192: mol_type = other DNA

SEQ ID NO: 619 - protein, 64 aa, synthetic construct; identical to SEQ ID NO: 613

SEQ ID NO: 620 - DNA, 192 bp, synthetic construct
  source 1..192: mol_type = other DNA
accgagtggaaattacggaaggaatactggcggatgagtgcgcggcgttgctcagtgacttctttcgcatgcgccgccaggtaattaaagcgcagaaaaaagcgcaatcctcgccggattccggtagcgaaacaccggggacttcagaatcggccaccccggagtctgataagaaatactcaataggcttag

SEQ ID NO: 621 - protein, 64 aa, synthetic construct
HRVEITEGILADECAALLSDFFRMRRQVIKAQKKAQSSPDSGSETPGTSESATPESDKKYSIGL

SEQ ID NO: 622 - DNA, 192 bp, synthetic construct
  source 1..192: mol_type = other DNA
accgagtggaaattacggaaggaatactggcggatgagtgcgcggcgttgctcagttacttctttcgcatgcgccgccaggtaattaaagcgcagaaaaaagcgcaatcctcgacggattccggtagcgaaacaccggggacttcagaatcggccaccccggagtctgataagaaatactcaataggcttag

SEQ ID NO: 623 - protein, 64 aa, synthetic construct
HRVEITEGILADECAALLSYFFRMRRQVIKAQKKAQSSTDSGSETPGTSESATPESDKKYSIGL

SEQ ID NO: 624 - DNA, 60 bp, synthetic construct
  source 1..60: mol_type = other DNA
gacaggatgaggatcctttcgcatgatcgaacaagatggattgcacgcaggttctccggc

SEQ ID NO: 625 - protein, 13 aa, synthetic construct
MIEQDGLHAGSPA

SEQ ID NO: 626 - DNA, 60 bp, synthetic construct
  source 1..60: mol_type = other DNA
gacaggatgaggatcctttcgcatgatcgaataagatggattgcacgcaggttctccggc

SEQ ID NO: 627 - skipped

SEQ ID NO: 628 - DNA, 60 bp, synthetic construct; identical to SEQ ID NO: 624
  source 1..60: mol_type = other DNA

SEQ ID NO: 629 - DNA, 81 bp, synthetic construct
  source 1..81: mol_type = other DNA
atgattgaacaagatggattgcacgcaggttctccggccgcttgggtggagcgcctattcggctatgactgggcacaacag

SEQ ID NO: 630 - protein, 27 aa, synthetic construct
MIEQDGLHAGSPAAWVERLFGYDWAQQ

SEQ ID NO: 631 - DNA, 81 bp, synthetic construct
  source 1..81: mol_type = other DNA
atgattgaacaagatggattgcacgcaggttctccggccgcttaggtggagcgcctattcggctatgactgggcacaacag

SEQ ID NO: 632 - protein, 14 aa, synthetic construct
MIEQDGLHAGSPAA

SEQ ID NO: 633 - DNA, 81 bp, synthetic construct; identical to SEQ ID NO: 629
  source 1..81: mol_type = other DNA

SEQ ID NO: 634 - protein, 63 aa, synthetic construct
  VARIANT 27: note = X may be I or L
MPPAFITMXXXKSXVEXDDEYWMRHAXXXAKKAEAXGEVPVGAVLVXDGRVIGXGXNLRIGXH

SEQ ID NO: 635 - protein, 52 aa, synthetic construct
MSEVEFSHEYWMRHALTLAKRAWDEREVPVGAVLVHNNRVIGEGWNRPIGRH

SEQ ID NO: 636 - protein, 51 aa, synthetic construct
MSHMTNDIYFMTLAIEEAKKAAQLGEVPIGAIITKDDEVIARAHNLRETLQ

SEQ ID NO: 637 - protein, 63 aa, synthetic construct
MPPAFITGVTSLSDVELDHEYWMRHALTLAKRAWDEREVPVGAVLVHNHRVIGEGWNRPIGRH

SEQ ID NO: 638 - protein, 56 aa, synthetic construct
MDAAKVRSEFDEKMMRYALELADKAEALGEIPVGAVLVDDARNIIGEGWNLSIVQS

SEQ ID NO: 639 - protein, 46 aa, synthetic construct
MDEYWMQVAMQMAEKAEAAGEVPVGAVLVKDGQQIATGYNLSISQH

SEQ ID NO: 640 - protein, 48 aa, synthetic construct
MTQDELYMKEAIKEAKKAEEKGEVPIGAVLVINGEIIARAHNLRETEQ

SEQ ID NO: 641 - protein, 56 aa, synthetic construct
MSSLKKTPIRDDAYWMGKAIREAAKAAARDEVPIGAVIVRDGAVIGRGHNLREGSN

SEQ ID NO: 642 - protein, 64 aa, synthetic construct
DPTAHAEIIALRQAXKVLQNYRLLXATLYVTLEPCVMCAGAXVHSRIXRVVFGARDPKTGAAGS

SEQ ID NO: 643 - protein, 64 aa, synthetic construct
DPTAHAEIMALRQGGLVMQNYRLIDATLYVTLEPCVMCAGAMIHSRIGRVVFGARDAKTGAAGS

SEQ ID NO: 644 - protein, 64 aa, synthetic construct
QPTAHAEHIAIERAAKVLGSWRLEGCTLYVTLEPCVMCAGTIVMSRIPRVVYGADDPKGGCSGS

SEQ ID NO: 645 - protein, 64 aa, synthetic construct
DPTAHAEIMALRQGGLVLQNYRLLDTTLYVTLEPCVMCAGAMVHSRIGRVVFGARDAKTGAAGS

SEQ ID NO: 646 - protein, 64 aa, synthetic construct
DPTAHAEIIALRNGAKNIQNYRLLNSTLYVTLEPCTMCAGAILHSRIKRLVFGASDYKTGAIGS

SEQ ID NO: 647 - protein, 64 aa, synthetic construct
DPTAHAEILCLRSAGKKLENYRLLDATLYITLEPCAMCAGAMVHSRIARVVYGARDEKTGAAGT

SEQ ID NO: 648 - protein, 64 aa, synthetic construct
RSIAHAEMLVIDEACKALGTWRLEGATLYVTLEPCPMCAGAVVLSRVEKVVFGAFDPKGGCSGT

SEQ ID NO: 649 - protein, 64 aa, synthetic construct
DPSAHAEMIAIRQAARRSANWRLTGATLYVTLEPCLMCMGAIILARLERVVFGCYDPKGGAAGS

SEQ ID NO: 650 - protein, 56 aa, synthetic construct
LMBLLQHPXXNHXVEXTSGVLAEECSTLLSDFFRMRRQEKKAXKXAXKXLSEXXAV

SEQ ID NO: 651 - protein, 51 aa, synthetic construct
LMDVLHHPGMNHRVEITEGILADECAALLSDFFRMRRQEIKAQKKAQSSTD

SEQ ID NO: 652 - protein, 44 aa, synthetic construct
LMNLLQQSNFNHRAIVDKGVLKEACSTLLTTFFKNLRANKKSTN

SEQ ID NO: 653 - protein, 56 aa, synthetic construct
LIDVLHHPGMNHRVEIIEGVLRDECATLLSDFFRMRRQEIKALKKADRAEGAGPAV

SEQ ID NO: 654 - protein, 53 aa, synthetic construct
RFHFFDDYKMNHTLEITSGVLAEECSQKLSTFFQKRREEKKIEKALLKSLSDK

SEQ ID NO: 655 - protein, 55 aa, synthetic construct
VVNLLQHPAFNHQVEVTSGVLAEACSAQLSRFFEKRRRDEKKALKLAQRAQQGIE

SEQ ID NO: 656 - protein, 49 aa, synthetic construct
LMNLLQEERFNHQAEVVSGVLEEECGGMLSAFFRELRKKKKAARKNLSE

SEQ ID NO: 657 - protein, 59 aa, synthetic construct
LYDLSADPRLNHQVRLSPGVCQEECGTMLSDFFRDLRRRKKAKATPALFIDERKVPPEP

SEQ ID NO: 658 - DNA, 131 bp, synthetic construct
  source 1..131: mol_type = other DNA
aagatctgatcaagagacaggatgaggatcctttcgcatgatcgaacaagatggattgcacgcaggttctccggccgcttgggtggagcgcctattcggctatgactgggcacaacagacaatcggctgct

SEQ ID NO: 659 - protein, 31 aa, synthetic construct
MIEQDGLHAGSPAAWVERLFGYDWAQQTIGC

SEQ ID NO: 660 - DNA, 131 bp, synthetic construct
  source 1..131: mol_type = other DNA
aagatctgatcaagagacaggatgaggatcctttcgcatgatcgaataagatggattgcacgcaggttctccggccgcttaggtggagcgcctattcggctatgactgggcacaacagacaatcggctgct

SEQ ID NO: 661 - skipped

SEQ ID NO: 662 - DNA, 96 bp, synthetic construct; identical to SEQ ID NO: 361
  source 1..96: mol_type = other DNA

SEQ ID NO: 663 - protein, 32 aa, synthetic construct
TSASPGESEILRAVEVIIVVHDDIIPWRYPAK

SEQ ID NO: 664 - DNA, 96 bp, synthetic construct
  source 1..96: mol_type = other DNA
cttcggcttcccctggagagagcgagattctccgcgctgtagaagtcaccattgttgtgcacgacgacatcattccgtggcgttatccagctaagc

SEQ ID NO: 665 - protein, 32 aa, synthetic construct
TSASPGESEILRAVEVTIVVHDDIIPWRYPAK

SEQ ID NO: 666 - DNA, 96 bp, synthetic construct; identical to SEQ ID NO: 664
  source 1..96: mol_type = other DNA

SEQ ID NO: 667 - protein, 32 aa, synthetic construct; identical to SEQ ID NO: 665

SEQ ID NO: 668 - DNA, 96 bp, synthetic construct; identical to SEQ ID NO: 664
  source 1..96: mol_type = other DNA

SEQ ID NO: 669 - protein, 32 aa, synthetic construct; identical to SEQ ID NO: 665

SEQ ID NO: 670 - DNA, 96 bp, synthetic construct; identical to SEQ ID NO: 664
  source 1..96: mol_type = other DNA

SEQ ID NO: 671 - protein, 32 aa, synthetic construct; identical to SEQ ID NO: 665

SEQ ID NO: 672 - protein, 166 aa, synthetic construct
SEVEFSHEYWMRHALTLAKRAWDEREVPVGAVLVHNNRVIGEGWNRSIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 673 - protein, 166 aa, synthetic construct
SEVEFSHEYWMRHALTLAKRAWDEREVPVGAVLVHNNRVIGEGWNRTIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 674 - protein, 166 aa, synthetic construct
SEVEFSHEYWMRHALTLAKRAWDEREVPVGAVLVHNNRVIGEGWNRAIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 675 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECNALLSDFFRMRRQEIKAQKKAQSSTD

SEQ ID NO: 676 - protein, 166 aa, synthetic construct
SEVEFSHEYWMRHALTLAKRARDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 677 - protein, 166 aa, synthetic construct
SEVEFSHEYWMRHALTLAKRALDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 678 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMPRQEIKAQKKAQSSTD

SEQ ID NO: 679 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMHRQEIKAQKKAQSSTD

SEQ ID NO: 680 - protein, 166 aa, synthetic construct; identical to SEQ ID NO: 73

SEQ ID NO: 681 - protein, 166 aa, synthetic construct
SEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 682 - protein, 166 aa, synthetic construct
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 683 - protein, 166 aa, synthetic construct
SEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 684 - protein, 166 aa, synthetic construct
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 685 - protein, 24 aa, synthetic construct
SGGSSGGSSGSETPGTSESATPES

SEQ ID NO: 686 - protein, 40 aa, synthetic construct
SGGSSGGSSGSETPGTSESATPESSGGSSGGSSGGSSGGS

SEQ ID NO: 687 - protein, 64 aa, synthetic construct
SGGSSGGSSGSETPGTSESATPESSGGSSGGSSGGSSGGSSGSETPGTSESATPESSGGSSGGS

SEQ ID NO: 688 - protein, 92 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 689 - protein, 579 aa, synthetic construct
GTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 690 - protein, 409 aa, synthetic construct
EAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 691 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 692 - protein, 1767 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 693 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 694 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 695 - protein, 1767 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 696 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 697 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 698 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 699 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 700 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 701 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 702 - protein, 1775 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 703 - protein, 1775 aa, synthetic construct; identical to SEQ ID NO: 700

SEQ ID NO: 704 - protein, 1767 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 705 - protein, 1767 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 706 - protein, 1767 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 707 - DNA, 20 bp, synthetic construct
  source 1..20: mol_type = other DNA
gcttaggtggagcgcctatt

SEQ ID NO: 708 - DNA, 20 bp, synthetic construct
  source 1..20: mol_type = other DNA
agtcactccacccaagcggc

SEQ ID NO: 709 - DNA, 20 bp, synthetic construct
  source 1..20: mol_type = other DNA
gtcacccctgcgctgacagc

SEQ ID NO: 710 - DNA, 20 bp, synthetic construct
  source 1..20: mol_type = other DNA
atcttattcgatcatgcgaa

SEQ ID NO: 711 - DNA, 20 bp, synthetic construct
  source 1..20: mol_type = other DNA
gcttaggtggagcgcctatt

SEQ ID NO: 712 - DNA, 20 bp, synthetic construct
  source 1..20: mol_type = other DNA
gcttaggtggagcgcctatt

SEQ ID NO: 713 - DNA, 20 bp, synthetic construct
  source 1..20: mol_type = other DNA
gcttaggtggagcgcctatt

SEQ ID NO: 714 - DNA, 20 bp, synthetic construct
  source 1..20: mol_type = other DNA
atcttattcgatcatgcgaa

SEQ ID NO: 715 - DNA, 20 bp, synthetic construct
  source 1..20: mol_type = other DNA
agtcactccacccaagcggc

SEQ ID NO: 716 - DNA, 20 bp, synthetic construct
  source 1..20: mol_type = other DNA
gcttaggtggagcgcctatt

SEQ ID NO: 717 - DNA, 20 bp, synthetic construct
  source 1..20: mol_type = other DNA
gtcacccctgcgctgacagc

SEQ ID NO: 718 - DNA, 20 bp, synthetic construct
  source 1..20: mol_type = other DNA
gcttaggtggagcgcctatt

SEQ ID NO: 719 - DNA, 20 bp, synthetic construct
  source 1..20: mol_type = other DNA
gtcacccctgcgctgacagc

SEQ ID NO: 720 - DNA, 20 bp, synthetic construct
  source 1..20: mol_type = other DNA
tactgtgtaatgtatctgga

SEQ ID NO: 721 - DNA, 20 bp, synthetic construct
  source 1..20: mol_type = other DNA
tactgcgtagtgcacctgga

SEQ ID NO: 722 - DNA, 20 bp, synthetic construct
  source 1..20: mol_type = other DNA
taccgcgtagtgcacctgga

SEQ ID NO: 723 - DNA, 20 bp, synthetic construct
  source 1..20: mol_type = other DNA
tacagcgtagtgcacctgga

SEQ ID NO: 724 - DNA, 20 bp, synthetic construct
  source 1..20: mol_type = other DNA
tacggcgtaatgcacctgga

SEQ ID NO: 725 - DNA, 20 bp, synthetic construct
  source 1..20: mol_type = other DNA
tacggcatagtgcacctgga

SEQ ID NO: 726 - DNA, 20 bp, synthetic construct
  source 1..20: mol_type = other DNA
tacggcgtagtgtacctgga

SEQ ID NO: 727 - DNA, 20 bp, synthetic construct
  source 1..20: mol_type = other DNA
tacggcgtagtggacctgga

SEQ ID NO: 728 - DNA, 20 bp, synthetic construct
  source 1..20: mol_type = other DNA
tacggcgtagtgaacctgga

SEQ ID NO: 729 - DNA, 20 bp, synthetic construct
  source 1..20: mol_type = other DNA
tacggcgtagtgcacttgga

SEQ ID NO: 730 - DNA, 20 bp, synthetic construct
  source 1..20: mol_type = other DNA
cgtagtgcacctggatggcc

SEQ ID NO: 731 - DNA, 20 bp, synthetic construct
  source 1..20: mol_type = other DNA
taccgcgtagtgaacttgga

SEQ ID NO: 732 - DNA, 20 bp, synthetic construct
  source 1..20: mol_type = other DNA
taccgcatagtgaacttgga

SEQ ID NO: 733 - DNA, 20 bp, synthetic construct
  source 1..20: mol_type = other DNA
gcttaggtggagcgcctatt

SEQ ID NO: 734 - DNA, 20 bp, synthetic construct
  source 1..20: mol_type = other DNA
atcttattcgatcatgcgaa

SEQ ID NO: 735 - DNA, 20 bp, synthetic construct
  source 1..20: mol_type = other DNA
tacggcgtagtgcacctgga

SEQ ID NO: 736 - DNA, 20 bp, synthetic construct
  source 1..20: mol_type = other DNA
caatgatgacttctacagcg

SEQ ID NO: 737 - DNA, 20 bp, synthetic construct
  source 1..20: mol_type = other DNA
tacggcgtagtgcacctgga

SEQ ID NO: 738 - DNA, 20 bp, synthetic construct
  source 1..20: mol_type = other DNA
ttcattaactgtggccggct

SEQ ID NO: 739 - DNA, 20 bp, synthetic construct
  source 1..20: mol_type = other DNA
atcttattcgatcatgcgaa

SEQ ID NO: 740 - DNA, 23 bp, synthetic construct
  source 1..23: mol_type = other DNA
ccgagccggtgtccyggcgcact

SEQ ID NO: 741 - DNA, 23 bp, synthetic construct
  source 1..23: mol_type = other DNA
cccggcgcactgagctgtycatt

SEQ ID NO: 742 - DNA, 23 bp, synthetic construct
  source 1..23: mol_type = other DNA
ccggcgcactgagctgtycattg

SEQ ID NO: 743 - DNA, 23 bp, synthetic construct
  source 1..23: mol_type = other DNA
gcatgcrccagtgccttgggcgg

SEQ ID NO: 744 - DNA, 23 bp, synthetic construct
  source 1..23: mol_type = other DNA
tgcctrgtacccgccactgctgg

SEQ ID NO: 745 - DNA, 23 bp, synthetic construct
  source 1..23: mol_type = other DNA
aacctcagrtgagggcaggcagg

SEQ ID NO: 746 - DNA, 23 bp, synthetic construct
  source 1..23: mol_type = other DNA
ggtccrgacccactggctgctgg

SEQ ID NO: 747 - DNA, 23 bp, synthetic construct
  source 1..23: mol_type = other DNA
ggctrcgtcagcaagatccttgg

SEQ ID NO: 748 - DNA, 23 bp, synthetic construct
  source 1..23: mol_type = other DNA
cttgcrgtgggtgctggctgagg

SEQ ID NO: 749 - DNA, 23 bp, synthetic construct
  source 1..23: mol_type = other DNA
gacctcgrccaagacccggcagg

SEQ ID NO: 750 - DNA, 23 bp, synthetic construct
  source 1..23: mol_type = other DNA
cttrgggtaggtcatggccatgg

SEQ ID NO: 751 - DNA, 23 bp, synthetic construct
  source 1..23: mol_type = other DNA
ctgrctccagctgtcgtcactgg

SEQ ID NO: 752 - DNA, 23 bp, synthetic construct
  source 1..23: mol_type = other DNA
agtrggtgagcacaaaagaacgg

SEQ ID NO: 753 - DNA, 23 bp, synthetic construct
  source 1..23: mol_type = other DNA
gcaarggtaccagcttagacagg

SEQ ID NO: 754 - DNA, 23 bp, synthetic construct
  source 1..23: mol_type = other DNA
gtgtgrgaacgacctctctcagg

SEQ ID NO: 755 - DNA, 23 bp, synthetic construct
  source 1..23: mol_type = other DNA
cccgaccrggacacgtggaaggg

SEQ ID NO: 756 - DNA, 23 bp, synthetic construct
  source 1..23: mol_type = other DNA
ccccgaccrggacacgtggaagg

SEQ ID NO: 757 - DNA, 23 bp, synthetic construct
  source 1..23: mol_type = other DNA
ggagrttggtctcgcaggttggg

SEQ ID NO: 758 - DNA, 23 bp, synthetic construct
  source 1..23: mol_type = other DNA
gggagrttggtctcgcaggttgg

SEQ ID NO: 759 - DNA, 23 bp, synthetic construct
  source 1..23: mol_type = other DNA
tcargtacctggaagctgtgagg

SEQ ID NO: 760 - DNA, 23 bp, synthetic construct
  source 1..23: mol_type = other DNA
tggraggttgatacctgccgggg

SEQ ID NO: 761 - DNA, 23 bp, synthetic construct
  source 1..23: mol_type = other DNA
atggraggttgatacctgccggg

SEQ ID NO: 762 - DNA, 23 bp, synthetic construct
  source 1..23: mol_type = other DNA
catggraggttgatacctgccgg

SEQ ID NO: 763 - DNA, 23 bp, synthetic construct
  source 1..23: mol_type = other DNA
tttccagrgatggagtctgctgg

SEQ ID NO: 764 - DNA, 23 bp, synthetic construct
  source 1..23: mol_type = other DNA
ggactrtgaccagcatagaaagg

SEQ ID NO: 765 - DNA, 23 bp, synthetic construct
  source 1..23: mol_type = other DNA
gcgaaaacrgcgggccccactgg

SEQ ID NO: 766 - DNA, 23 bp, synthetic construct
  source 1..23: mol_type = other DNA
agtgagctrgactcctcctttgg

SEQ ID NO: 767 - DNA, 23 bp, synthetic construct
  source 1..23: mol_type = other DNA
gttgttgcrccgctccacgatgg

SEQ ID NO: 768 - DNA, 23 bp, synthetic construct
  source 1..23: mol_type = other DNA
gttaaatrgggaaaggtggatgg

SEQ ID NO: 769 - DNA, 23 bp, synthetic construct
  source 1..23: mol_type = other DNA
ggagggcraggagcagaggtggg

SEQ ID NO: 770 - DNA, 23 bp, synthetic construct
  source 1..23: mol_type = other DNA
tggagggcraggagcagaggtgg

SEQ ID NO: 771 - DNA, 23 bp, synthetic construct
  source 1..23: mol_type = other DNA
tgagatcraggacttgatggtgg

SEQ ID NO: 772 - DNA, 23 bp, synthetic construct
  source 1..23: mol_type = other DNA
acttcracaaggtgggccctggg

SEQ ID NO: 773 - DNA, 23 bp, synthetic construct
  source 1..23: mol_type = other DNA
aacttcracaaggtgggccctgg

SEQ ID NO: 774 - DNA, 23 bp, synthetic construct
  source 1..23: mol_type = other DNA
aaaggagrtgccggcatcagagg

SEQ ID NO: 775 - DNA, 23 bp, synthetic construct
  source 1..23: mol_type = other DNA
gtgatcrgagacgagaactacgg

SEQ ID NO: 776 - DNA, 23 bp, synthetic construct
  source 1..23: mol_type = other DNA
ggagggcraggagcagaggtggg

SEQ ID NO: 777 - DNA, 23 bp, synthetic construct
  source 1..23: mol_type = other DNA
tggagggcraggagcagaggtgg

SEQ ID NO: 778 - DNA, 23 bp, synthetic construct
  source 1..23: mol_type = other DNA
gtgrgtggagatgcacgttaagg

SEQ ID NO: 779 - DNA, 23 bp, synthetic construct
  source 1..23: mol_type = other DNA
tcctrgcttttgtcaaggcaggg

SEQ ID NO: 780 - DNA, 23 bp, synthetic construct
  source 1..23: mol_type = other DNA
gtcctrgcttttgtcaaggcagg

SEQ ID NO: 781 - DNA, 23 bp, synthetic construct
  source 1..23: mol_type = other DNA
ctaragtgtaagtttcatgaggg

SEQ ID NO: 782 - DNA, 23 bp, synthetic construct
  source 1..23: mol_type = other DNA
actaragtgtaagtttcatgagg

SEQ ID NO: 783 - DNA, 23 bp, synthetic construct
  source 1..23: mol_type = other DNA
ggtgaccrcgtcgctggccaagg

SEQ ID NO: 784 - DNA, 23 bp, synthetic construct
  source 1..23: mol_type = other DNA
ccagraagcatggggaacatggg

SEQ ID NO: 785 - DNA, 23 bp, synthetic construct
  source 1..23: mol_type = other DNA
accagraagcatggggaacatgg

SEQ ID NO: 786 - DNA, 23 bp, synthetic construct
  source 1..23: mol_type = other DNA
gcggcrcaacaacctgctgcagg

SEQ ID NO: 787 - DNA, 23 bp, synthetic construct
  source 1..23: mol_type = other DNA
atcgrgctcatcggtcctccggg

SEQ ID NO: 788 - DNA, 23 bp, synthetic construct
  source 1..23: mol_type = other DNA
gatcgrgctcatcggtcctccgg

SEQ ID NO: 789 - DNA, 23 bp, synthetic construct
  source 1..23: mol_type = other DNA
aaaatctaracaaaaaaggaagg

SEQ ID NO: 790 - DNA, 23 bp, synthetic construct
  source 1..23: mol_type = other DNA
ggtgcrtgcagtccggtggcagg

SEQ ID NO: 791 - DNA, 23 bp, synthetic construct
  source 1..23: mol_type = other DNA
acttcrtacaggggggctcgagg

SEQ ID NO: 792 - DNA, 23 bp, synthetic construct
  source 1..23: mol_type = other DNA
tccagcrctgccaagcctgctgg

SEQ ID NO: 793 - DNA, 23 bp, synthetic construct
  source 1..23: mol_type = other DNA
tgccctrcgggccgggggagcgg

SEQ ID NO: 794 - DNA, 23 bp, synthetic construct
  source 1..23: mol_type = other DNA
ttcaacraggccaagcccatcgg

SEQ ID NO: 795 - DNA, 23 bp, synthetic construct
  source 1..23: mol_type = other DNA
aatagrccacattcaaaggatgg

SEQ ID NO: 796 - DNA, 23 bp, synthetic construct
  source 1..23: mol_type = other DNA
ggagragtacagcgccatgcggg

SEQ ID NO: 797 - DNA, 23 bp, synthetic construct
  source 1..23: mol_type = other DNA
aggagragtacagcgccatgcgg

SEQ ID NO: 798 - DNA, 23 bp, synthetic construct
  source 1..23: mol_type = other DNA
cctctacraggaggagatgcggg

SEQ ID NO: 799 - DNA, 23 bp, synthetic construct
  source 1..23: mol_type = other DNA
acctctacraggaggagatgcgg

SEQ ID NO: 800 - DNA, 23 bp, synthetic construct
  source 1..23: mol_type = other DNA
tccragtgatccgtcttgctagg

SEQ ID NO: 801 - DNA, 23 bp, synthetic construct
  source 1..23: mol_type = other DNA
atgggcrtaaatttgtttgctgg

SEQ ID NO: 802 - DNA, 23 bp, synthetic construct
  source 1..23: mol_type = other DNA
catttcrgaacactgagccaagg

SEQ ID NO: 803 - DNA, 23 bp, synthetic construct
  source 1..23: mol_type = other DNA
aactcrctccctcatttctaagg

SEQ ID NO: 804 - DNA, 23 bp, synthetic construct
  source 1..23: mol_type = other DNA
gtgtrggaacgacctctctcagg

SEQ ID NO: 805 - DNA, 23 bp, synthetic construct
  source 1..23: mol_type = other DNA
gaaaartataaagagtatcttgg

SEQ ID NO: 806 - DNA, 23 bp, synthetic construct
  source 1..23: mol_type = other DNA
gccrgagaaaagggagaaacggg

SEQ ID NO: 807 - DNA, 23 bp, synthetic construct
  source 1..23: mol_type = other DNA
agccrgagaaaagggagaaacgg

SEQ ID NO: 808 - DNA, 23 bp, synthetic construct
  source 1..23: mol_type = other DNA
gggattgrgacatgtggatgcgg

SEQ ID NO: 809 - DNA, 23 bp, synthetic construct
  source 1..23: mol_type = other DNA
catggaggrcttgacagccaagg

SEQ ID NO: 810 - DNA, 23 bp, synthetic construct
  source 1..23: mol_type = other DNA
cctggtgrctgtgcgttctgggg

SEQ ID NO: 811 - DNA, 23 bp, synthetic construct
  source 1..23: mol_type = other DNA
ccctggtgrctgtgcgttctggg

SEQ ID NO: 812 - DNA, 23 bp, synthetic construct
  source 1..23: mol_type = other DNA
ctgrggggccatggatgctaagg

SEQ ID NO: 813 - DNA, 23 bp, synthetic construct
  source 1..23: mol_type = other DNA
ctttgacraagctcacaacgtgg

SEQ ID NO: 814 - DNA, 23 bp, synthetic construct
  source 1..23: mol_type = other DNA
agtttccraaacacagtggaagg

SEQ ID NO: 815 - DNA, 23 bp, synthetic construct
  source 1..23: mol_type = other DNA
acaacatcraagtcctggagggg

SEQ ID NO: 816 - DNA, 23 bp, synthetic construct
  source 1..23: mol_type = other DNA
gggcgrctgggagctgagcgtgg

SEQ ID NO: 817 - DNA, 23 bp, synthetic construct
  source 1..23: mol_type = other DNA
gcagtatraggacatggtcgtgg

SEQ ID NO: 818 - DNA, 23 bp, synthetic construct
  source 1..23: mol_type = other DNA
cccagacragctggagaagctgg

SEQ ID NO: 819 - DNA, 23 bp, synthetic construct
  source 1..23: mol_type = other DNA
catcrgcttctcctgggtgaggg

SEQ ID NO: 820 - DNA, 23 bp, synthetic construct
  source 1..23: mol_type = other DNA
gcatcrgcttctcctgggtgagg

SEQ ID NO: 821 - DNA, 23 bp, synthetic construct
  source 1..23: mol_type = other DNA
tgtcrgcatcaaatccacactgg

SEQ ID NO: 822 - DNA, 23 bp, synthetic construct
  source 1..23: mol_type = other DNA
aaaagctcrattttttggccggg

SEQ ID NO: 823 - DNA, 23 bp, synthetic construct
  source 1..23: mol_type = other DNA
tggaacragcattttgggattgg

SEQ ID NO: 824 - DNA, 23 bp, synthetic construct
  source 1..23: mol_type = other DNA
ccatgctggaggggtgatcygaa

SEQ ID NO: 825 - DNA, 23 bp, synthetic construct
  source 1..23: mol_type = other DNA
ccttggatatgcgaggaygatgc

SEQ ID NO: 826 - DNA, 23 bp, synthetic construct
  source 1..23: mol_type = other DNA
cctttgtccccgcaggtgaygca

SEQ ID NO: 827 - DNA, 23 bp, synthetic construct
  source 1..23: mol_type = other DNA
ccagcggcacgctggcccyggtg

SEQ ID NO: 828 - DNA, 23 bp, synthetic construct
  source 1..23: mol_type = other DNA
ccagggctgtgaacyaggccatc

SEQ ID NO: 829 - DNA, 23 bp, synthetic construct
  source 1..23: mol_type = other DNA
ccagaagaagtaactygaacagt

SEQ ID NO: 830 - DNA, 23 bp, synthetic construct
  source 1..23: mol_type = other DNA
ccctttgaagccatgycccggcg

SEQ ID NO: 831 - DNA, 23 bp, synthetic construct
  source 1..23: mol_type = other DNA
cctttgaagccatgycccggcgt

SEQ ID NO: 832 - DNA, 23 bp, synthetic construct
  source 1..23: mol_type = other DNA
ccggaagtcagccttgcagygag

SEQ ID NO: 833 - DNA, 23 bp, synthetic construct
  source 1..23: mol_type = other DNA
ccccagctcagcaacagcaygac

SEQ ID NO: 834 - DNA, 23 bp, synthetic construct
  source 1..23: mol_type = other DNA
cccagctcagcaacagcaygacg

SEQ ID NO: 835 - DNA, 23 bp, synthetic construct
  source 1..23: mol_type = other DNA
ccagctcagcaacagcaygacgg

SEQ ID NO: 836 - DNA, 23 bp, synthetic construct
  source 1..23: mol_type = other DNA
cctgagaaggacgtgtttcygaa

SEQ ID NO: 837 - DNA, 23 bp, synthetic construct
  source 1..23: mol_type = other DNA
ccgcaaaagcctatacctygacc

SEQ ID NO: 838 - DNA, 23 bp, synthetic construct
  source 1..23: mol_type = other DNA
ccgtcttgctaggattggcygaa

SEQ ID NO: 839 - DNA, 23 bp, synthetic construct
  source 1..23: mol_type = other DNA
cctgcgcaggcttcyctgggagt

SEQ ID NO: 840 - DNA, 23 bp, synthetic construct
  source 1..23: mol_type = other DNA
ccgctcagccaccaggcyccact

SEQ ID NO: 841 - DNA, 23 bp, synthetic construct
  source 1..23: mol_type = other DNA
cctgggggacctcagagyagagt

SEQ ID NO: 842 - DNA, 23 bp, synthetic construct
  source 1..23: mol_type = other DNA
ccggccgcgccgcaagaagyagg

SEQ ID NO: 843 - DNA, 23 bp, synthetic construct
  source 1..23: mol_type = other DNA
ccgcgccgcaagaagyaggcgcg

SEQ ID NO: 844 - DNA, 23 bp, synthetic construct
  source 1..23: mol_type = other DNA
ccccgcaggtgacgyagctggac

SEQ ID NO: 845 - DNA, 23 bp, synthetic construct
  source 1..23: mol_type = other DNA
cccagcactactgtacygtgtgg

SEQ ID NO: 846 - DNA, 23 bp, synthetic construct
  source 1..23: mol_type = other DNA
ccagcactactgtacygtgtgga

SEQ ID NO: 847 - DNA, 23 bp, synthetic construct
  source 1..23: mol_type = other DNA
cccctaaagtcacttggygaaaa

SEQ ID NO: 848 - DNA, 23 bp, synthetic construct
  source 1..23: mol_type = other DNA
ccctaaagtcacttggygaaaag

SEQ ID NO: 849 - DNA, 23 bp, synthetic construct
  source 1..23: mol_type = other DNA
cctaaagtcacttggygaaaagt

SEQ ID NO: 850 - DNA, 23 bp, synthetic construct
  source 1..23: mol_type = other DNA
ccgtgtaggacaggccygagaaa

SEQ ID NO: 851 - DNA, 23 bp, synthetic construct
  source 1..23: mol_type = other DNA
ccattcagagcttaygagggaca

SEQ ID NO: 852 - DNA, 23 bp, synthetic construct
  source 1..23: mol_type = other DNA
cccccgtgttcacayagcagcag

SEQ ID NO: 853 - DNA, 23 bp, synthetic construct
  source 1..23: mol_type = other DNA
cctcacggtcttggygttgccaa

SEQ ID NO: 854 - DNA, 23 bp, synthetic construct
  source 1..23: mol_type = other DNA
ccactgcgtgtggcatatcyagg

SEQ ID NO: 855 - DNA, 23 bp, synthetic construct
  source 1..23: mol_type = other DNA
ccaggccccgcccttcaacyagg

SEQ ID NO: 856 - DNA, 23 bp, synthetic construct
  source 1..23: mol_type = other DNA
ccccgcccttcaacyagggcttc

SEQ ID NO: 857 - DNA, 23 bp, synthetic construct
  source 1..23: mol_type = other DNA
ccgacctggatggcttygatata

SEQ ID NO: 858 - DNA, 23 bp, synthetic construct
  source 1..23: mol_type = other DNA
ccgccacaacctctygctcaacg

SEQ ID NO: 859 - DNA, 23 bp, synthetic construct
  source 1..23: mol_type = other DNA
ccccttcatcgaggaggytgagc

SEQ ID NO: 860 - DNA, 23 bp, synthetic construct
  source 1..23: mol_type = other DNA
cccttcatcgaggaggytgagcg

SEQ ID NO: 861 - DNA, 23 bp, synthetic construct
  source 1..23: mol_type = other DNA
ccttcatcgaggaggytgagcgg

SEQ ID NO: 862 - DNA, 23 bp, synthetic construct
  source 1..23: mol_type = other DNA
ccccatgacacctggctgcycaa

SEQ ID NO: 863 - DNA, 23 bp, synthetic construct
  source 1..23: mol_type = other DNA
cccatgacacctggctgcycaag

SEQ ID NO: 864 - DNA, 23 bp, synthetic construct
  source 1..23: mol_type = other DNA
ccatgacacctggctgcycaaga

SEQ ID NO: 865 - DNA, 23 bp, synthetic construct
  source 1..23: mol_type = other DNA
ccagaccgtcttcttgttcytca

SEQ ID NO: 866 - DNA, 23 bp, synthetic construct
  source 1..23: mol_type = other DNA
ccgtcttcttgttcytcattgcc

SEQ ID NO: 867 - DNA, 23 bp, synthetic construct
  source 1..23: mol_type = other DNA
ccgtgacgtggctgcctcyggcc

SEQ ID NO: 868 - DNA, 23 bp, synthetic construct
  source 1..23: mol_type = other DNA
ccggggcttccagggcygccact

SEQ ID NO: 869 - DNA, 23 bp, synthetic construct
  source 1..23: mol_type = other DNA
ccacggtggggttcatgcygctg

SEQ ID NO: 870 - DNA, 23 bp, synthetic construct
  source 1..23: mol_type = other DNA
ccgggaggcagaccatcagyctc

SEQ ID NO: 871 - DNA, 23 bp, synthetic construct
  source 1..23: mol_type = other DNA
cctccccaggggtgygggttacc

SEQ ID NO: 872 - DNA, 23 bp, synthetic construct
  source 1..23: mol_type = other DNA
cccgggggagcctgaycctggac

SEQ ID NO: 873 - DNA, 23 bp, synthetic construct
  source 1..23: mol_type = other DNA
ccgggggagcctgaycctggacg

SEQ ID NO: 874 - DNA, 23 bp, synthetic construct
  source 1..23: mol_type = other DNA
ccaatgcctactcacytagacat

SEQ ID NO: 875 - DNA, 23 bp, synthetic construct
  source 1..23: mol_type = other DNA
ccatgtccaaacttaygctttgg

SEQ ID NO: 876 - DNA, 23 bp, synthetic construct
  source 1..23: mol_type = other DNA
ccctgctaccagcatttcyggag

SEQ ID NO: 877 - DNA, 23 bp, synthetic construct
  source 1..23: mol_type = other DNA
cctgctaccagcatttcyggagg

SEQ ID NO: 878 - DNA, 23 bp, synthetic construct
  source 1..23: mol_type = other DNA
ccttgactgttgagcygggcctt

SEQ ID NO: 879 - DNA, 23 bp, synthetic construct
  source 1..23: mol_type = other DNA
cctccttgattattaaaygacta

SEQ ID NO: 880 - DNA, 23 bp, synthetic construct
  source 1..23: mol_type = other DNA
ccttgattattaaaygactaact

SEQ ID NO: 881 - DNA, 23 bp, synthetic construct
  source 1..23: mol_type = other DNA
ccagagaggtctctcagggygaa

SEQ ID NO: 882 - DNA, 23 bp, synthetic construct
  source 1..23: mol_type = other DNA
cccgtaaataaaccttyagacca

SEQ ID NO: 883 - DNA, 23 bp, synthetic construct
  source 1..23: mol_type = other DNA
ccgtaaataaaccttyagaccag

SEQ ID NO: 884 - DNA, 23 bp, synthetic construct
  source 1..23: mol_type = other DNA
cctgcagcgggtggcctyctccc

SEQ ID NO: 885 - DNA, 23 bp, synthetic construct
  source 1..23: mol_type = other DNA
cctctaagagccttatctygatt

SEQ ID NO: 886 - DNA, 23 bp, synthetic construct
  source 1..23: mol_type = other DNA
ccttccaaggtctcctatyagcc

SEQ ID NO: 887 - DNA, 23 bp, synthetic construct
  source 1..23: mol_type = other DNA
ccaaggtctcctatyagccaatc

SEQ ID NO: 888 - DNA, 23 bp, synthetic construct
  source 1..23: mol_type = other DNA
ccctgagccaaaccygggatgtc

SEQ ID NO: 889 - DNA, 23 bp, synthetic construct
  source 1..23: mol_type = other DNA
ccctgctgcacatcgacygacat

SEQ ID NO: 890 - DNA, 23 bp, synthetic construct
  source 1..23: mol_type = other DNA
cctgctgcacatcgacygacatc

SEQ ID NO: 891 - DNA, 23 bp, synthetic construct
  source 1..23: mol_type = other DNA
cctcatcaccatccacgacygaa

SEQ ID NO: 892 - DNA, 23 bp, synthetic construct
  source 1..23: mol_type = other DNA
cccaattatacagaaatcygaca

SEQ ID NO: 893 - DNA, 23 bp, synthetic construct
  source 1..23: mol_type = other DNA
ccaattatacagaaatcygacag

SEQ ID NO: 894 - DNA, 23 bp, synthetic construct
  source 1..23: mol_type = other DNA
ccccagttcctcttaccyggaag

SEQ ID NO: 895 - DNA, 23 bp, synthetic construct
  source 1..23: mol_type = other DNA
cccagttcctcttaccyggaagc

SEQ ID NO: 896 - DNA, 23 bp, synthetic construct
  source 1..23: mol_type = other DNA
ccagttcctcttaccyggaagct

SEQ ID NO: 897 - DNA, 23 bp, synthetic construct
  source 1..23: mol_type = other DNA
ccactccagttgctgyccccttt

SEQ ID NO: 898 - DNA, 23 bp, synthetic construct
  source 1..23: mol_type = other DNA
ccttagtgatattgacyagagtt

SEQ ID NO: 899 - DNA, 23 bp, synthetic construct
  source 1..23: mol_type = other DNA
cccttcccatgacaaataygtac

SEQ ID NO: 900 - DNA, 23 bp, synthetic construct
  source 1..23: mol_type = other DNA
ccttcccatgacaaataygtacc

SEQ ID NO: 901 - DNA, 23 bp, synthetic construct
  source 1..23: mol_type = other DNA
ccgcctcctccagctgcttyagg

SEQ ID NO: 902 - DNA, 23 bp, synthetic construct
  source 1..23: mol_type = other DNA
cctcctccagctgcttyaggcta

SEQ ID NO: 903 - DNA, 23 bp, synthetic construct
  source 1..23: mol_type = other DNA
ccatgtttttttccttgygactc

SEQ ID NO: 904 - DNA, 23 bp, synthetic construct
  source 1..23: mol_type = other DNA
ccattggacacagaatcygagtg

SEQ ID NO: 905 - DNA, 23 bp, synthetic construct
  source 1..23: mol_type = other DNA
ccagatgctggatgtgctgyagg

SEQ ID NO: 906 - DNA, 23 bp, synthetic construct
  source 1..23: mol_type = other DNA
ccaaggacaagtttyggagaatg

SEQ ID NO: 907 - DNA, 23 bp, synthetic construct
  source 1..23: mol_type = other DNA
cccgttttcttcttgtttaygag

SEQ ID NO: 908 - DNA, 23 bp, synthetic construct
  source 1..23: mol_type = other DNA
ccgttttcttcttgtttaygaga

SEQ ID NO: 909 - DNA, 23 bp, synthetic construct
  source 1..23: mol_type = other DNA
cccacctggcttcagaacaytca

SEQ ID NO: 910 - DNA, 23 bp, synthetic construct
  source 1..23: mol_type = other DNA
ccacctggcttcagaacaytcat

SEQ ID NO: 911 - DNA, 23 bp, synthetic construct
  source 1..23: mol_type = other DNA
cctggcttcagaacaytcatgtc

SEQ ID NO: 912 - DNA, 23 bp, synthetic construct
  source 1..23: mol_type = other DNA
ccgcacgctgctctttgytttga

SEQ ID NO: 913 - DNA, 23 bp, synthetic construct
  source 1..23: mol_type = other DNA
ccagaatactgaataccaayaac

SEQ ID NO: 914 - DNA, 23 bp, synthetic construct
  source 1..23: mol_type = other DNA
cccacaccagctgcatttthagc

SEQ ID NO: 915 - DNA, 23 bp, synthetic construct
  source 1..23: mol_type = other DNA
ccacaccagctgcatttthagca

SEQ ID NO: 916 - DNA, 23 bp, synthetic construct
  source 1..23: mol_type = other DNA
ccccaaaaatctcagcygacttt

SEQ ID NO: 917 - DNA, 23 bp, synthetic construct
  source 1..23: mol_type = other DNA
cccaaaaatctcagcygactttt

SEQ ID NO: 918 - DNA, 23 bp, synthetic construct
  source 1..23: mol_type = other DNA
ccaaaaatctcagcygacttttc

SEQ ID NO: 919 - DNA, 23 bp, synthetic construct
  source 1..23: mol_type = other DNA
cccgccgtttttgttyagtctac

SEQ ID NO: 920 - DNA, 23 bp, synthetic construct
  source 1..23: mol_type = other DNA
ccgccgtttttgttyagtctacc

SEQ ID NO: 921 - DNA, 23 bp, synthetic construct
  source 1..23: mol_type = other DNA
ccaagtgaaatttagaagaygac

SEQ ID NO: 922 - DNA, 23 bp, synthetic construct
  source 1..23: mol_type = other DNA
ccttgaggaattctcytggtgaa

SEQ ID NO: 923 - DNA, 23 bp, synthetic construct
  source 1..23: mol_type = other DNA
ccatttggctttgggcccygtgg

SEQ ID NO: 924 - DNA, 23 bp, synthetic construct
  source 1..23: mol_type = other DNA
cccatggaagcagaggygcagtg

SEQ ID NO: 925 - DNA, 23 bp, synthetic construct
  source 1..23: mol_type = other DNA
ccatggaagcagaggygcagtgc

SEQ ID NO: 926 - DNA, 23 bp, synthetic construct
  source 1..23: mol_type = other DNA
ccctttggtagatgaycccgcat

SEQ ID NO: 927 - DNA, 23 bp, synthetic construct
  source 1..23: mol_type = other DNA
cctttggtagatgaycccgcatg

SEQ ID NO: 928 - DNA, 23 bp, synthetic construct
  source 1..23: mol_type = other DNA
cctgggccatggccggaygctgt

SEQ ID NO: 929 - DNA, 23 bp, synthetic construct
  source 1..23: mol_type = other DNA
ccgtaccgagaagccycaagagg

SEQ ID NO: 930 - DNA, 23 bp, synthetic construct
  source 1..23: mol_type = other DNA
ccagccatccacctcayagatcg

SEQ ID NO: 931 - DNA, 23 bp, synthetic construct
  source 1..23: mol_type = other DNA
ccccgaagacagagctgyagtcg

SEQ ID NO: 932 - DNA, 23 bp, synthetic construct
  source 1..23: mol_type = other DNA
cccgaagacagagctgyagtcgg

SEQ ID NO: 933 - DNA, 23 bp, synthetic construct
  source 1..23: mol_type = other DNA
ccgaagacagagctgyagtcggg

SEQ ID NO: 934 - DNA, 23 bp, synthetic construct
  source 1..23: mol_type = other DNA
ccatcttcgtctgggcttyggga

SEQ ID NO: 935 - DNA, 23 bp, synthetic construct
  source 1..23: mol_type = other DNA
ccctgttgccaatgtctygctga

SEQ ID NO: 936 - DNA, 23 bp, synthetic construct
  source 1..23: mol_type = other DNA
cctgttgccaatgtctygctgac

SEQ ID NO: 937 - DNA, 23 bp, synthetic construct
  source 1..23: mol_type = other DNA
cctccacaggttaacatcygaaa

SEQ ID NO: 938 - DNA, 23 bp, synthetic construct
  source 1..23: mol_type = other DNA
ccacaggttaacatcygaaaaag

SEQ ID NO: 939 - DNA, 23 bp, synthetic construct
  source 1..23: mol_type = other DNA
cccggccatgcttgyggacatgc

SEQ ID NO: 940 - DNA, 23 bp, synthetic construct
  source 1..23: mol_type = other DNA
ccaggctcggcatttctggyagc

SEQ ID NO: 941 - DNA, 23 bp, synthetic construct
  source 1..23: mol_type = other DNA
cccactgcctggtcaagyagcta

SEQ ID NO: 942 - DNA, 23 bp, synthetic construct
  source 1..23: mol_type = other DNA
ccactgcctggtcaagyagctac

SEQ ID NO: 943 - DNA, 23 bp, synthetic construct
  source 1..23: mol_type = other DNA
ccacgacaggctggtacygcatg

SEQ ID NO: 944 - DNA, 23 bp, synthetic construct
  source 1..23: mol_type = other DNA
ccgccgatttgccaacygagtcc

SEQ ID NO: 945 - DNA, 23 bp, synthetic construct
  source 1..23: mol_type = other DNA
ccgcctttcactgtatcagygag

SEQ ID NO: 946 - DNA, 23 bp, synthetic construct
  source 1..23: mol_type = other DNA
cctttcactgtatcagygagccg

SEQ ID NO: 947 - DNA, 23 bp, synthetic construct
  source 1..23: mol_type = other DNA
ccaggtcagtagtgcttcyggtg

SEQ ID NO: 948 - DNA, 23 bp, synthetic construct
  source 1..23: mol_type = other DNA
ccaggaaggctgcctygtcctct

SEQ ID NO: 949 - DNA, 23 bp, synthetic construct
  source 1..23: mol_type = other DNA
ccttatcatgaatggccygccga

SEQ ID NO: 950 - DNA, 23 bp, synthetic construct
  source 1..23: mol_type = other DNA
gggargaccatgggtaaggaggg

SEQ ID NO: 951 - DNA, 23 bp, synthetic construct
  source 1..23: mol_type = other DNA
tgggargaccatgggtaaggagg

SEQ ID NO: 952 - DNA, 23 bp, synthetic construct
  source 1..23: mol_type = other DNA
ccatgggargaccatgggtaagg

SEQ ID NO: 953 - DNA, 23 bp, synthetic construct
  source 1..23: mol_type = other DNA
ccccgactacagcatcytctcct

SEQ ID NO: 954 - DNA, 23 bp, synthetic construct
  source 1..23: mol_type = other DNA
cccgactacagcatcytctcctt

SEQ ID NO: 955 - DNA, 23 bp, synthetic construct
  source 1..23: mol_type = other DNA
ccgactacagcatcytctccttc

SEQ ID NO: 956 - DNA, 23 bp, synthetic construct
  source 1..23: mol_type = other DNA
cctgggccacaatggagygggga

SEQ ID NO: 957 - DNA, 23 bp, synthetic construct
  source 1..23: mol_type = other DNA
atgttctcrccgaagtatatggg

SEQ ID NO: 958 - DNA, 23 bp, synthetic construct
  source 1..23: mol_type = other DNA
ctgrctctctgctctgctgtggg

SEQ ID NO: 959 - DNA, 23 bp, synthetic construct
  source 1..23: mol_type = other DNA
tctgrctctctgctctgctgtgg

SEQ ID NO: 960 - DNA, 23 bp, synthetic construct
  source 1..23: mol_type = other DNA
gtcccagraggaggcccagctgg

SEQ ID NO: 961 - DNA, 23 bp, synthetic construct
  source 1..23: mol_type = other DNA
ggacraggccgacctccttgggg

SEQ ID NO: 962 - DNA, 23 bp, synthetic construct
  source 1..23: mol_type = other DNA
tggacraggccgacctccttggg

SEQ ID NO: 963 - DNA, 23 bp, synthetic construct
  source 1..23: mol_type = other DNA
atggacraggccgacctccttgg

SEQ ID NO: 964 - DNA, 23 bp, synthetic construct
  source 1..23: mol_type = other DNA
tgtcgragttcgccctggagagg

SEQ ID NO: 965 - DNA, 23 bp, synthetic construct
  source 1..23: mol_type = other DNA
cccagctgttccagaagyagaaa

SEQ ID NO: 966 - DNA, 23 bp, synthetic construct
  source 1..23: mol_type = other DNA
ccagctgttccagaagyagaaat

SEQ ID NO: 967 - DNA, 23 bp, synthetic construct
  source 1..23: mol_type = other DNA
ccatcggccgagtatgyaggact

SEQ ID NO: 968 - DNA, 23 bp, synthetic construct
  source 1..23: mol_type = other DNA
cctgattcacctgcagcaygaag

SEQ ID NO: 969 - DNA, 23 bp, synthetic construct
  source 1..23: mol_type = other DNA
cccacagatcgtgctccyggcta

SEQ ID NO: 970 - DNA, 23 bp, synthetic construct
  source 1..23: mol_type = other DNA
ccacagatcgtgctccyggctac

SEQ ID NO: 971 - DNA, 23 bp, synthetic construct
  source 1..23: mol_type = other DNA
cctagtgctttggcytcctggga

SEQ ID NO: 972 - DNA, 23 bp, synthetic construct
  source 1..23: mol_type = other DNA
gggatttcrgatgagggctctgg

SEQ ID NO: 973 - DNA, 23 bp, synthetic construct
  source 1..23: mol_type = other DNA
ccttctggtatggatycactcta

SEQ ID NO: 974 - DNA, 23 bp, synthetic construct
  source 1..23: mol_type = other DNA
cctatgccggttgttttygattt

SEQ ID NO: 975 - DNA, 23 bp, synthetic construct
  source 1..23: mol_type = other DNA
cctttcatcgagacgttayccca

SEQ ID NO: 976 - DNA, 23 bp, synthetic construct
  source 1..23: mol_type = other DNA
ggcrtctggactctgtcaccagg

SEQ ID NO: 977 - DNA, 23 bp, synthetic construct
  source 1..23: mol_type = other DNA
gagrgtgggatctggatcgacgg

SEQ ID NO: 978 - DNA, 23 bp, synthetic construct
  source 1..23: mol_type = other DNA
ccagggcagcacagtggtcyggg

SEQ ID NO: 979 - DNA, 23 bp, synthetic construct
  source 1..23: mol_type = other DNA
ccagaggatcagtttcccgygac

SEQ ID NO: 980 - DNA, 23 bp, synthetic construct
  source 1..23: mol_type = other DNA
cccacatggctgagaygttccag

SEQ ID NO: 981 - DNA, 23 bp, synthetic construct
  source 1..23: mol_type = other DNA
ccacatggctgagaygttccagg

SEQ ID NO: 982 - DNA, 23 bp, synthetic construct
  source 1..23: mol_type = other DNA
cctggccagtgggctgctgyggc

SEQ ID NO: 983 - DNA, 23 bp, synthetic construct
  source 1..23: mol_type = other DNA
ccagtgggctgctgyggctccag

SEQ ID NO: 984 - DNA, 23 bp, synthetic construct
  source 1..23: mol_type = other DNA
cctcttcagcggcaccatcyggt

SEQ ID NO: 985 - DNA, 23 bp, synthetic construct
  source 1..23: mol_type = other DNA
ccactttggtgatgaycaacaag

SEQ ID NO: 986 - DNA, 23 bp, synthetic construct
  source 1..23: mol_type = other DNA
ccttggaatctctaactygctca

SEQ ID NO: 987 - DNA, 23 bp, synthetic construct
  source 1..23: mol_type = other DNA
tggcccrcatgttctaccacagg

SEQ ID NO: 988 - DNA, 23 bp, synthetic construct
  source 1..23: mol_type = other DNA
ggtggcragaagcagagaatcgg

SEQ ID NO: 989 - DNA, 23 bp, synthetic construct
  source 1..23: mol_type = other DNA
tcgraggagatcgccttctatgg

SEQ ID NO: 990 - DNA, 23 bp, synthetic construct
  source 1..23: mol_type = other DNA
gttcrgggagctggtggcagagg

SEQ ID NO: 991 - DNA, 23 bp, synthetic construct
  source 1..23: mol_type = other DNA
tccrgatcctgggtgggctctgg

SEQ ID NO: 992 - DNA, 23 bp, synthetic construct
  source 1..23: mol_type = other DNA
gactrgaaggacgtcctgtcggg

SEQ ID NO: 993 - DNA, 23 bp, synthetic construct
  source 1..23: mol_type = other DNA
tgactrgaaggacgtcctgtcgg

SEQ ID NO: 994 - DNA, 23 bp, synthetic construct
  source 1..23: mol_type = other DNA
ccaggtgatctaccyggactcag

SEQ ID NO: 995 - DNA, 23 bp, synthetic construct
  source 1..23: mol_type = other DNA
cctgcaccacatcctgcagyggg

SEQ ID NO: 996 - DNA, 23 bp, synthetic construct
  source 1..23: mol_type = other DNA
ccaaggcatcctcataycacatc

SEQ ID NO: 997 - DNA, 23 bp, synthetic construct
  source 1..23: mol_type = other DNA
caagtggragatggaacgcacgg

SEQ ID NO: 998 - DNA, 23 bp, synthetic construct
  source 1..23: mol_type = other DNA
cccccgttctatatcatcaytga

SEQ ID NO: 999 - DNA, 23 bp, synthetic construct
  source 1..23: mol_type = other DNA
ccccgttctatatcatcaytgag

SEQ ID NO: 1000 - DNA, 23 bp, synthetic construct
  source 1..23: mol_type = other DNA
cccgttctatatcatcaytgagt

SEQ ID NO: 1001 - DNA, 23 bp, synthetic construct
  source 1..23: mol_type = other DNA
ccgttctatatcatcaytgagtt

SEQ ID NO: 1002 - DNA, 23 bp, synthetic construct
  source 1..23: mol_type = other DNA
ccgtacgagcgcatactgygtga

SEQ ID NO: 1003 - DNA, 23 bp, synthetic construct
  source 1..23: mol_type = other DNA
ccaacrgaggaaaagctaattgg

SEQ ID NO: 1004 - DNA, 23 bp, synthetic construct
  source 1..23: mol_type = other DNA
tcagrgcatcagtgccttcctgg

SEQ ID NO: 1005 - DNA, 23 bp, synthetic construct
  source 1..23: mol_type = other DNA
agccgtgrctgcgcctccaccgg

SEQ ID NO: 1006 - DNA, 23 bp, synthetic construct
  source 1..23: mol_type = other DNA
ccggcagagcggcactacygcga

SEQ ID NO: 1007 - DNA, 23 bp, synthetic construct
  source 1..23: mol_type = other DNA
ccaatgcctgggaggyttcggct

SEQ ID NO: 1008 - DNA, 23 bp, synthetic construct
  source 1..23: mol_type = other DNA
ccaagctggccgcctyggaggcc

SEQ ID NO: 1009 - DNA, 23 bp, synthetic construct
  source 1..23: mol_type = other DNA
cctggccctggagagtgccyggc

SEQ ID NO: 1010 - DNA, 23 bp, synthetic construct
  source 1..23: mol_type = other DNA
ccctggagagtgccyggctgctg

SEQ ID NO: 1011 - DNA, 23 bp, synthetic construct
  source 1..23: mol_type = other DNA
ccatggaggagatcagcygtggc

SEQ ID NO: 1012 - DNA, 23 bp, synthetic construct
  source 1..23: mol_type = other DNA
ccgagaaggagttgtttcycatt

SEQ ID NO: 1013 - DNA, 23 bp, synthetic construct
  source 1..23: mol_type = other DNA
atcragtggatggggggagtagg

SEQ ID NO: 1014 - DNA, 23 bp, synthetic construct
  source 1..23: mol_type = other DNA
cctgaaaacaaattggggytcag

SEQ ID NO: 1015 - DNA, 23 bp, synthetic construct
  source 1..23: mol_type = other DNA
gggggrtatgggcttcatgaagg

SEQ ID NO: 1016 - DNA, 23 bp, synthetic construct
  source 1..23: mol_type = other DNA
tatggrcttcatgaaggtacagg

SEQ ID NO: 1017 - DNA, 23 bp, synthetic construct
  source 1..23: mol_type = other DNA
ccgagatcttcgcatcttcygga

SEQ ID NO: 1018 - DNA, 23 bp, synthetic construct
  source 1..23: mol_type = other DNA
ccccaggctgcagctyggatccg

SEQ ID NO: 1019 - DNA, 23 bp, synthetic construct
  source 1..23: mol_type = other DNA
cccaggctgcagctyggatccga

SEQ ID NO: 1020 - DNA, 23 bp, synthetic construct
  source 1..23: mol_type = other DNA
gaacracaggaccatcgaagggg

SEQ ID NO: 1021 - DNA, 23 bp, synthetic construct
  source 1..23: mol_type = other DNA
tgaacracaggaccatcgaaggg

SEQ ID NO: 1022 - DNA, 23 bp, synthetic construct
  source 1..23: mol_type = other DNA
ctgaacracaggaccatcgaagg

SEQ ID NO: 1023 - DNA, 23 bp, synthetic construct
  source 1..23: mol_type = other DNA
aggactgtrtggtgatgatctgg

SEQ ID NO: 1024 - DNA, 23 bp, synthetic construct
  source 1..23: mol_type = other DNA
ccgcagtacaactggacgcygaa

SEQ ID NO: 1025 - DNA, 23 bp, synthetic construct
  source 1..23: mol_type = other DNA
ccttaggaactcaccttygaggc

SEQ ID NO: 1026 - DNA, 23 bp, synthetic construct
  source 1..23: mol_type = other DNA
gtcatgratgagtggcggtgtgg

SEQ ID NO: 1027 - DNA, 23 bp, synthetic construct
  source 1..23: mol_type = other DNA
ccagtactggatccgaggcygga

SEQ ID NO: 1028 - DNA, 23 bp, synthetic construct
  source 1..23: mol_type = other DNA
cctccacgtgctccygctgcacc

SEQ ID NO: 1029 - DNA, 23 bp, synthetic construct
  source 1..23: mol_type = other DNA
ctacragctgccagacgggcagg

SEQ ID NO: 1030 - DNA, 23 bp, synthetic construct
  source 1..23: mol_type = other DNA
agagctacragctgccagacggg

SEQ ID NO: 1031 - DNA, 23 bp, synthetic construct
  source 1..23: mol_type = other DNA
cctgaagtaccctatcgagyacg

SEQ ID NO: 1032 - DNA, 23 bp, synthetic construct
  source 1..23: mol_type = other DNA
gacrtcccagacatcaggtgagg

SEQ ID NO: 1033 - DNA, 23 bp, synthetic construct
  source 1..23: mol_type = other DNA
tgtgggacrtcccagacatcagg

SEQ ID NO: 1034 - DNA, 23 bp, synthetic construct
  source 1..23: mol_type = other DNA
atcatgcrtctggatctggctgg

SEQ ID NO: 1035 - DNA, 23 bp, synthetic construct
  source 1..23: mol_type = other DNA
cccatccattgtgggabgtccca

SEQ ID NO: 1036 - DNA, 23 bp, synthetic construct
  source 1..23: mol_type = other DNA
ccatccattgtgggabgtcccag

SEQ ID NO: 1037 - DNA, 23 bp, synthetic construct
  source 1..23: mol_type = other DNA
caaccgcragaagatgacccagg

SEQ ID NO: 1038 - DNA, 23 bp, synthetic construct
  source 1..23: mol_type = other DNA
gcacrgcatcgtcaccaactggg

SEQ ID NO: 1039 - DNA, 23 bp, synthetic construct
  source 1..23: mol_type = other DNA
agcacrgcatcgtcaccaactgg

SEQ ID NO: 1040 - DNA, 23 bp, synthetic construct
  source 1..23: mol_type = other DNA
cctcaccctgaagtaccycatcg

SEQ ID NO: 1041 - DNA, 23 bp, synthetic construct
  source 1..23: mol_type = other DNA
ccaaccgcgagaagatgayccag

SEQ ID NO: 1042 - DNA, 23 bp, synthetic construct
  source 1..23: mol_type = other DNA
ccgcgagaagatgayccaggtga

SEQ ID NO: 1043 - DNA, 23 bp, synthetic construct
  source 1..23: mol_type = other DNA
cctctggccgtaccaytggcatc

SEQ ID NO: 1044 - DNA, 23 bp, synthetic construct
  source 1..23: mol_type = other DNA
ccggaggcgctgttccagcyttc

SEQ ID NO: 1045 - DNA, 23 bp, synthetic construct
  source 1..23: mol_type = other DNA
ccaacagagagaagatgaytcag

SEQ ID NO: 1046 - DNA, 23 bp, synthetic construct
  source 1..23: mol_type = other DNA
ccccggccatgtacgtggycatc

SEQ ID NO: 1047 - DNA, 23 bp, synthetic construct
  source 1..23: mol_type = other DNA
cccggccatgtacgtggycatcc

SEQ ID NO: 1048 - DNA, 23 bp, synthetic construct
  source 1..23: mol_type = other DNA
ccggccatgtacgtggycatcca

SEQ ID NO: 1049 - DNA, 23 bp, synthetic construct
  source 1..23: mol_type = other DNA
cctgccccatgccatcatgygcc

SEQ ID NO: 1050 - DNA, 23 bp, synthetic construct
  source 1..23: mol_type = other DNA
ccccatgccatcatgygcctgga

SEQ ID NO: 1051 - DNA, 23 bp, synthetic construct
  source 1..23: mol_type = other DNA
cccatgccatcatgygcctggac

SEQ ID NO: 1052 - DNA, 23 bp, synthetic construct
  source 1..23: mol_type = other DNA
ccattgtgggccgccctygccac

SEQ ID NO: 1053 - DNA, 23 bp, synthetic construct
  source 1..23: mol_type = other DNA
ggcrtcaaactggtgtccatcgg

SEQ ID NO: 1054 - DNA, 23 bp, synthetic construct
  source 1..23: mol_type = other DNA
ccarccatacatcctggcggagg

SEQ ID NO: 1055 - DNA, 23 bp, synthetic construct
  source 1..23: mol_type = other DNA
ttcccarccatacatcctggcgg

SEQ ID NO: 1056 - DNA, 23 bp, synthetic construct
  source 1..23: mol_type = other DNA
ggcrctgaaggtgagaggtgtgg

SEQ ID NO: 1057 - DNA, 23 bp, synthetic construct
  source 1..23: mol_type = other DNA
ccattggcrctgaaggtgagagg

SEQ ID NO: 1058 - DNA, 23 bp, synthetic construct
  source 1..23: mol_type = other DNA
ctggagcrcaccaaccagagcgg

SEQ ID NO: 1059 - DNA, 23 bp, synthetic construct
  source 1..23: mol_type = other DNA
aagrccgctatggcgaagtgtgg

SEQ ID NO: 1060 - DNA, 23 bp, synthetic construct
  source 1..23: mol_type = other DNA
cagtrttgcatcgccgacctggg

SEQ ID NO: 1061 - DNA, 23 bp, synthetic construct
  source 1..23: mol_type = other DNA
gcagtrttgcatcgccgacctgg

SEQ ID NO: 1062 - DNA, 23 bp, synthetic construct
  source 1..23: mol_type = other DNA
cccgagagtgggcaccaagyggt

SEQ ID NO: 1063 - DNA, 23 bp, synthetic construct
  source 1..23: mol_type = other DNA
ccgagagtgggcaccaagyggta

SEQ ID NO: 1064 - DNA, 23 bp, synthetic construct
  source 1..23: mol_type = other DNA
cccgactcaccgcgctgyggatc

SEQ ID NO: 1065 - DNA, 23 bp, synthetic construct
  source 1..23: mol_type = other DNA
ccgactcaccgcgctgyggatca

SEQ ID NO: 1066 - DNA, 23 bp, synthetic construct
  source 1..23: mol_type = other DNA
tcaccrtactgtccacgccgggg

SEQ ID NO: 1067 - DNA, 23 bp, synthetic construct
  source 1..23: mol_type = other DNA
ttcaccrtactgtccacgccggg

SEQ ID NO: 1068 - DNA, 23 bp, synthetic construct
  source 1..23: mol_type = other DNA
attcaccrtactgtccacgccgg

SEQ ID NO: 1069 - DNA, 23 bp, synthetic construct
  source 1..23: mol_type = other DNA
ccacgccrgggaggtgggctcgg

SEQ ID NO: 1070 - DNA, 23 bp, synthetic construct
  source 1..23: mol_type = other DNA
cctttccagaacatcaatgyggc

SEQ ID NO: 1071 - DNA, 23 bp, synthetic construct
  source 1..23: mol_type = other DNA
ccagaacatcaatgyggccaaat

SEQ ID NO: 1072 - DNA, 23 bp, synthetic construct
  source 1..23: mol_type = other DNA
ccatcctgtgctgcatgygccac

SEQ ID NO: 1073 - DNA, 23 bp, synthetic construct
  source 1..23: mol_type = other DNA
cccttcccaggggctgcygggag

SEQ ID NO: 1074 - DNA, 23 bp, synthetic construct
  source 1..23: mol_type = other DNA
ccttcccaggggctgcygggagg

SEQ ID NO: 1075 - DNA, 23 bp, synthetic construct
  source 1..23: mol_type = other DNA
ccgagcccacctccccggygtgg

SEQ ID NO: 1076 - DNA, 23 bp, synthetic construct
  source 1..23: mol_type = other DNA
acgcacrccttccggtctcaagg

SEQ ID NO: 1077 - DNA, 23 bp, synthetic construct
  source 1..23: mol_type = other DNA
cctgaagcgatcggtcagcygag

SEQ ID NO: 1078 - DNA, 23 bp, synthetic construct
  source 1..23: mol_type = other DNA
gcctgagrtaggcatggagctgg

SEQ ID NO: 1079 - DNA, 23 bp, synthetic construct
  source 1..23: mol_type = other DNA
ggtrtatgccaagtggcccccgg

SEQ ID NO: 1080 - DNA, 23 bp, synthetic construct
  source 1..23: mol_type = other DNA
tgctcccrctcctgcggaggagg

SEQ ID NO: 1081 - DNA, 23 bp, synthetic construct
  source 1..23: mol_type = other DNA
actrtgcagtggccattgggcgg

SEQ ID NO: 1082 - DNA, 23 bp, synthetic construct
  source 1..23: mol_type = other DNA
cagactrtgcagtggccattggg

SEQ ID NO: 1083 - DNA, 23 bp, synthetic construct
  source 1..23: mol_type = other DNA
gcagactrtgcagtggccattgg

SEQ ID NO: 1084 - DNA, 23 bp, synthetic construct
  source 1..23: mol_type = other DNA
acarggggcagaactgcttcggg

SEQ ID NO: 1085 - DNA, 23 bp, synthetic construct
  source 1..23: mol_type = other DNA
cacarggggcagaactgcttcgg

SEQ ID NO: 1086 - DNA, 23 bp, synthetic construct
  source 1..23: mol_type = other DNA
ccactggggtgctgctgtaycac

SEQ ID NO: 1087 - DNA, 23 bp, synthetic construct
  source 1..23: mol_type = other DNA
ccaggaggacacagagygctatg

SEQ ID NO: 1088 - DNA, 23 bp, synthetic construct
  source 1..23: mol_type = other DNA
cccagcggacacgtgatggyttc

SEQ ID NO: 1089 - DNA, 23 bp, synthetic construct
  source 1..23: mol_type = other DNA
ccagcggacacgtgatggyttcg

SEQ ID NO: 1090 - DNA, 23 bp, synthetic construct
  source 1..23: mol_type = other DNA
ccacggggccgaggccgccyaga

SEQ ID NO: 1091 - DNA, 23 bp, synthetic construct
  source 1..23: mol_type = other DNA
ggagtrggagtacagagacgagg

SEQ ID NO: 1092 - DNA, 23 bp, synthetic construct
  source 1..23: mol_type = other DNA
ccctcctctcggggggccayagg

SEQ ID NO: 1093 - DNA, 23 bp, synthetic construct
  source 1..23: mol_type = other DNA
cctcctctcggggggccayaggc

SEQ ID NO: 1094 - DNA, 23 bp, synthetic construct
  source 1..23: mol_type = other DNA
cctctcggggggccayaggccct

SEQ ID NO: 1095 - DNA, 23 bp, synthetic construct
  source 1..23: mol_type = other DNA
agcrgcactgcctgcagcagagg

SEQ ID NO: 1096 - DNA, 23 bp, synthetic construct
  source 1..23: mol_type = other DNA
ccacatctccagcaaacygtgtg

SEQ ID NO: 1097 - DNA, 23 bp, synthetic construct
  source 1..23: mol_type = other DNA
ccacgtgacgggcaactatygca

SEQ ID NO: 1098 - DNA, 23 bp, synthetic construct
  source 1..23: mol_type = other DNA
ccagctgcgtactggaaaygagt

SEQ ID NO: 1099 - DNA, 23 bp, synthetic construct
  source 1..23: mol_type = other DNA
ctacraggtcaaggtgagcaggg

SEQ ID NO: 1100 - DNA, 23 bp, synthetic construct
  source 1..23: mol_type = other DNA
gctacraggtcaaggtgagcagg

SEQ ID NO: 1101 - DNA, 23 bp, synthetic construct
  source 1..23: mol_type = other DNA
cctcaccrgctacgaggtcaagg

SEQ ID NO: 1102 - DNA, 23 bp, synthetic construct
  source 1..23: mol_type = other DNA
cctgtgacgaggattggcyggct

SEQ ID NO: 1103 - DNA, 23 bp, synthetic construct
  source 1..23: mol_type = other DNA
cctaagccaggacctgyggaacc

SEQ ID NO: 1104 - DNA, 23 bp, synthetic construct
  source 1..23: mol_type = other DNA
cccctaccactttgtgtgcygag

SEQ ID NO: 1105 - DNA, 23 bp, synthetic construct
  source 1..23: mol_type = other DNA
ccctaccactttgtgtgcygagg

SEQ ID NO: 1106 - DNA, 23 bp, synthetic construct
  source 1..23: mol_type = other DNA
cctaccactttgtgtgcygaggc

SEQ ID NO: 1107 - DNA, 23 bp, synthetic construct
  source 1..23: mol_type = other DNA
agccctcratgtcagcaaacagg

SEQ ID NO: 1108 - DNA, 23 bp, synthetic construct
  source 1..23: mol_type = other DNA
ttgacrccaggagcattgatagg

SEQ ID NO: 1109 - DNA, 23 bp, synthetic construct
  source 1..23: mol_type = other DNA
tcatctrgtactggtccatgcgg

SEQ ID NO: 1110 - DNA, 23 bp, synthetic construct
  source 1..23: mol_type = other DNA
gccartaagtttggcacctgggg

SEQ ID NO: 1111 - DNA, 23 bp, synthetic construct
  source 1..23: mol_type = other DNA
agccartaagtttggcacctggg

SEQ ID NO: 1112 - DNA, 23 bp, synthetic construct
  source 1..23: mol_type = other DNA
cagccartaagtttggcacctgg

SEQ ID NO: 1113 - DNA, 23 bp, synthetic construct
  source 1..23: mol_type = other DNA
cccgcaggtgctggatcygggac

SEQ ID NO: 1114 - DNA, 23 bp, synthetic construct
  source 1..23: mol_type = other DNA
ccgcaggtgctggatcygggact

SEQ ID NO: 1115 - DNA, 23 bp, synthetic construct
  source 1..23: mol_type = other DNA
ccccaggggcctctacyacttct

SEQ ID NO: 1116 - DNA, 23 bp, synthetic construct
  source 1..23: mol_type = other DNA
cccaggggcctctacyacttctg

SEQ ID NO: 1117 - DNA, 23 bp, synthetic construct
  source 1..23: mol_type = other DNA
ccaggggcctctacyacttctgc

SEQ ID NO: 1118 - DNA, 23 bp, synthetic construct
  source 1..23: mol_type = other DNA
cccctggggaaaccattyaaacc

SEQ ID NO: 1119 - DNA, 23 bp, synthetic construct
  source 1..23: mol_type = other DNA
ccctggggaaaccattyaaacct

SEQ ID NO: 1120 - DNA, 23 bp, synthetic construct
  source 1..23: mol_type = other DNA
cctggggaaaccattyaaacctt

SEQ ID NO: 1121 - DNA, 23 bp, synthetic construct
  source 1..23: mol_type = other DNA
tccragatgacctgcgcttccgg

SEQ ID NO: 1122 - DNA, 23 bp, synthetic construct
  source 1..23: mol_type = other DNA
cccttgtcatggaccygctacag

SEQ ID NO: 1123 - DNA, 23 bp, synthetic construct
  source 1..23: mol_type = other DNA
ccttgtcatggaccygctacaga

SEQ ID NO: 1124 - DNA, 23 bp, synthetic construct
  source 1..23: mol_type = other DNA
ccagaacttgaagcgtgtcygag

SEQ ID NO: 1125 - DNA, 23 bp, synthetic construct
  source 1..23: mol_type = other DNA
ccagagtgatctctyggcttgcc

SEQ ID NO: 1126 - DNA, 23 bp, synthetic construct
  source 1..23: mol_type = other DNA
cccactgcctatgtgyggcccat

SEQ ID NO: 1127 - DNA, 23 bp, synthetic construct
  source 1..23: mol_type = other DNA
ccactgcctatgtgyggcccatg

SEQ ID NO: 1128 - DNA, 23 bp, synthetic construct
  source 1..23: mol_type = other DNA
aggatrtgtatgactttaggtgg

SEQ ID NO: 1129 - DNA, 23 bp, synthetic construct
  source 1..23: mol_type = other DNA
gataggatrtgtatgactttagg

SEQ ID NO: 1130 - DNA, 23 bp, synthetic construct
  source 1..23: mol_type = other DNA
ccctggagttcagtaytgtagga

SEQ ID NO: 1131 - DNA, 23 bp, synthetic construct
  source 1..23: mol_type = other DNA
cctggagttcagtaytgtaggag

SEQ ID NO: 1132 - DNA, 23 bp, synthetic construct
  source 1..23: mol_type = other DNA
tctccccrgtaggagcctcccgg

SEQ ID NO: 1133 - DNA, 23 bp, synthetic construct
  source 1..23: mol_type = other DNA
ctcggracactgtgccctggagg

SEQ ID NO: 1134 - DNA, 23 bp, synthetic construct
  source 1..23: mol_type = other DNA
tggctcggracactgtgccctgg

SEQ ID NO: 1135 - DNA, 23 bp, synthetic construct
  source 1..23: mol_type = other DNA
gccrgggggctgcagatgatcgg

SEQ ID NO: 1136 - DNA, 23 bp, synthetic construct
  source 1..23: mol_type = other DNA
aagtgrctggccaacttctgggg

SEQ ID NO: 1137 - DNA, 23 bp, synthetic construct
  source 1..23: mol_type = other DNA
caagtgrctggccaacttctggg

SEQ ID NO: 1138 - DNA, 23 bp, synthetic construct
  source 1..23: mol_type = other DNA
tcaagtgrctggccaacttctgg

SEQ ID NO: 1139 - DNA, 23 bp, synthetic construct
  source 1..23: mol_type = other DNA
acccacrgggagtcgtccaccgg

SEQ ID NO: 1140 - DNA, 23 bp, synthetic construct
  source 1..23: mol_type = other DNA
gtgctgcrgatcggcctgctggg

SEQ ID NO: 1141 - DNA, 23 bp, synthetic construct
  source 1..23: mol_type = other DNA
ggtgctgcrgatcggcctgctgg

SEQ ID NO: 1142 - DNA, 23 bp, synthetic construct
  source 1..23: mol_type = other DNA
ctcrcatcatggcagccgggggg

SEQ ID NO: 1143 - DNA, 23 bp, synthetic construct
  source 1..23: mol_type = other DNA
cctcrcatcatggcagccggggg

SEQ ID NO: 1144 - DNA, 23 bp, synthetic construct
  source 1..23: mol_type = other DNA
tcctcrcatcatggcagccgggg

SEQ ID NO: 1145 - DNA, 23 bp, synthetic construct
  source 1..23: mol_type = other DNA
ctcctcrcatcatggcagccggg

SEQ ID NO: 1146 - DNA, 23 bp, synthetic construct
  source 1..23: mol_type = other DNA
cctcctcrcatcatggcagccgg

SEQ ID NO: 1147 - DNA, 23 bp, synthetic construct
  source 1..23: mol_type = other DNA
caatrccacccgcgagaatgtgg

SEQ ID NO: 1148 - DNA, 23 bp, synthetic construct
  source 1..23: mol_type = other DNA
ccggggrgctgcagatgatcggg

SEQ ID NO: 1149 - DNA, 23 bp, synthetic construct
  source 1..23: mol_type = other DNA
gccggggrgctgcagatgatcgg

SEQ ID NO: 1150 - DNA, 23 bp, synthetic construct
  source 1..23: mol_type = other DNA
gcaratcatggacgagatcaagg

SEQ ID NO: 1151 - DNA, 23 bp, synthetic construct
  source 1..23: mol_type = other DNA
ttgrggccaatggcatttggggg

SEQ ID NO: 1152 - DNA, 23 bp, synthetic construct
  source 1..23: mol_type = other DNA
gttgrggccaatggcatttgggg

SEQ ID NO: 1153 - DNA, 23 bp, synthetic construct
  source 1..23: mol_type = other DNA
ggttgrggccaatggcatttggg

SEQ ID NO: 1154 - DNA, 23 bp, synthetic construct
  source 1..23: mol_type = other DNA
tggttgrggccaatggcatttgg

SEQ ID NO: 1155 - DNA, 23 bp, synthetic construct
  source 1..23: mol_type = other DNA
catttrggggcagcgagccgtgg

SEQ ID NO: 1156 - DNA, 23 bp, synthetic construct
  source 1..23: mol_type = other DNA
aactctrccacaggtgagcctgg

SEQ ID NO: 1157 - DNA, 23 bp, synthetic construct
  source 1..23: mol_type = other DNA
gtacaagtrcctgctcctggtgg

SEQ ID NO: 1158 - DNA, 23 bp, synthetic construct
  source 1..23: mol_type = other DNA
gtgrattcggtggcatccctggg

SEQ ID NO: 1159 - DNA, 23 bp, synthetic construct
  source 1..23: mol_type = other DNA
ggtgrattcggtggcatccctgg

SEQ ID NO: 1160 - DNA, 23 bp, synthetic construct
  source 1..23: mol_type = other DNA
cagctggcrccagcaccgcgagg

SEQ ID NO: 1161 - DNA, 23 bp, synthetic construct
  source 1..23: mol_type = other DNA
cctgcacccaggagccygagtgc

SEQ ID NO: 1162 - DNA, 23 bp, synthetic construct
  source 1..23: mol_type = other DNA
cctggccctcattgcggaayagg

SEQ ID NO: 1163 - DNA, 23 bp, synthetic construct
  source 1..23: mol_type = other DNA
ccctcattgcggaayaggtgcat

SEQ ID NO: 1164 - DNA, 23 bp, synthetic construct
  source 1..23: mol_type = other DNA
cctgcaggcactggggctgyagc

SEQ ID NO: 1165 - DNA, 23 bp, synthetic construct
  source 1..23: mol_type = other DNA
tcggactrggacctagaccctgg

SEQ ID NO: 1166 - DNA, 23 bp, synthetic construct
  source 1..23: mol_type = other DNA
ccgctgggctaagggtyggcgtg

SEQ ID NO: 1167 - DNA, 23 bp, synthetic construct
  source 1..23: mol_type = other DNA
gagccragagctgcaggccctgg

SEQ ID NO: 1168 - DNA, 23 bp, synthetic construct
  source 1..23: mol_type = other DNA
ccgggaggacgggatcyaaaaac

SEQ ID NO: 1169 - DNA, 23 bp, synthetic construct
  source 1..23: mol_type = other DNA
ccatcgtgtgcaccatgygagaa

SEQ ID NO: 1170 - DNA, 23 bp, synthetic construct
  source 1..23: mol_type = other DNA
gtgraatgaggccgaggccaagg

SEQ ID NO: 1171 - DNA, 23 bp, synthetic construct
  source 1..23: mol_type = other DNA
gacgrgggtggctctgtggctgg

SEQ ID NO: 1172 - DNA, 23 bp, synthetic construct
  source 1..23: mol_type = other DNA
tggggacgrgggtggctctgtgg

SEQ ID NO: 1173 - DNA, 23 bp, synthetic construct
  source 1..23: mol_type = other DNA
cccctgcagccccgcgcacytgg

SEQ ID NO: 1174 - DNA, 23 bp, synthetic construct
  source 1..23: mol_type = other DNA
ccctgcagccccgcgcacytggg

SEQ ID NO: 1175 - DNA, 23 bp, synthetic construct
  source 1..23: mol_type = other DNA
cctgcagccccgcgcacytgggt

SEQ ID NO: 1176 - DNA, 23 bp, synthetic construct
  source 1..23: mol_type = other DNA
tctccaccrgggacctcctgcgg

SEQ ID NO: 1177 - DNA, 23 bp, synthetic construct
  source 1..23: mol_type = other DNA
gaagrggcagctggttccactgg

SEQ ID NO: 1178 - DNA, 23 bp, synthetic construct
  source 1..23: mol_type = other DNA
ccctgagaccatgacccagyggc

SEQ ID NO: 1179 - DNA, 23 bp, synthetic construct
  source 1..23: mol_type = other DNA
cctgagaccatgacccagyggct

SEQ ID NO: 1180 - DNA, 23 bp, synthetic construct
  source 1..23: mol_type = other DNA
cccaaccctggagaggacaytca

SEQ ID NO: 1181 - DNA, 23 bp, synthetic construct
  source 1..23: mol_type = other DNA
ccaaccctggagaggacaytcag

SEQ ID NO: 1182 - DNA, 23 bp, synthetic construct
  source 1..23: mol_type = other DNA
ccctggagaggacaytcagggtc

SEQ ID NO: 1183 - DNA, 23 bp, synthetic construct
  source 1..23: mol_type = other DNA
tagggragtacatcaagacctgg

SEQ ID NO: 1184 - DNA, 23 bp, synthetic construct
  source 1..23: mol_type = other DNA
taccrcgacatcaaggttagtgg

SEQ ID NO: 1185 - DNA, 23 bp, synthetic construct
  source 1..23: mol_type = other DNA
caggtraatacatcaagacctgg

SEQ ID NO: 1186 - DNA, 23 bp, synthetic construct
  source 1..23: mol_type = other DNA
taggaraatatataaaaaactgg

SEQ ID NO: 1187 - DNA, 23 bp, synthetic construct
  source 1..23: mol_type = other DNA
ctcgccrtgtaccacgtctctgg

SEQ ID NO: 1188 - DNA, 23 bp, synthetic construct
  source 1..23: mol_type = other DNA
ctcrccgtgtaccacgtctctgg

SEQ ID NO: 1189 - DNA, 23 bp, synthetic construct
  source 1..23: mol_type = other DNA
ggtrtgggtagaggggttgaagg

SEQ ID NO: 1190 - DNA, 23 bp, synthetic construct
  source 1..23: mol_type = other DNA
ccctcatcccttaggacygggat

SEQ ID NO: 1191 - DNA, 23 bp, synthetic construct
  source 1..23: mol_type = other DNA
cctcatcccttaggacygggatg

SEQ ID NO: 1192 - DNA, 23 bp, synthetic construct
  source 1..23: mol_type = other DNA
atccaargtatccgtaacagtgg

SEQ ID NO: 1193 - DNA, 23 bp, synthetic construct
  source 1..23: mol_type = other DNA
cgacrtggacaaggctgtggagg

SEQ ID NO: 1194 - DNA, 23 bp, synthetic construct
  source 1..23: mol_type = other DNA
gcccgacrtggacaaggctgtgg

SEQ ID NO: 1195 - DNA, 23 bp, synthetic construct
  source 1..23: mol_type = other DNA
ccagaggggctcgccatggygcc

SEQ ID NO: 1196 - DNA, 23 bp, synthetic construct
  source 1..23: mol_type = other DNA
cccagtcacggagcggtyggcct

SEQ ID NO: 1197 - DNA, 23 bp, synthetic construct
  source 1..23: mol_type = other DNA
ccagtcacggagcggtyggcctt

SEQ ID NO: 1198 - DNA, 23 bp, synthetic construct
  source 1..23: mol_type = other DNA
gttagargagtgcttggactcgg

SEQ ID NO: 1199 - DNA, 23 bp, synthetic construct
  source 1..23: mol_type = other DNA
cccggagtcgtccccaggaygtt

SEQ ID NO: 1200 - DNA, 23 bp, synthetic construct
  source 1..23: mol_type = other DNA
ccggagtcgtccccaggaygttc

SEQ ID NO: 1201 - DNA, 23 bp, synthetic construct
  source 1..23: mol_type = other DNA
aattcrgtgaatgtagtatttgg

SEQ ID NO: 1202 - DNA, 23 bp, synthetic construct
  source 1..23: mol_type = other DNA
ccgagrcactgacatccgcatgg

SEQ ID NO: 1203 - DNA, 23 bp, synthetic construct
  source 1..23: mol_type = other DNA
cctggcggaggtgggyatcacct

SEQ ID NO: 1204 - DNA, 23 bp, synthetic construct
  source 1..23: mol_type = other DNA
gggrcctctgtcatgcatattgg

SEQ ID NO: 1205 - DNA, 23 bp, synthetic construct
  source 1..23: mol_type = other DNA
cctcatcccccataccygataca

SEQ ID NO: 1206 - DNA, 23 bp, synthetic construct
  source 1..23: mol_type = other DNA
cccacctgctggagacayacctc

SEQ ID NO: 1207 - DNA, 23 bp, synthetic construct
  source 1..23: mol_type = other DNA
ccacctgctggagacayacctca

SEQ ID NO: 1208 - DNA, 23 bp, synthetic construct
  source 1..23: mol_type = other DNA
ccttgggaatgaagcttygaggg

SEQ ID NO: 1209 - DNA, 23 bp, synthetic construct
  source 1..23: mol_type = other DNA
acattgacrtgagtgctcggggg

SEQ ID NO: 1210 - DNA, 23 bp, synthetic construct
  source 1..23: mol_type = other DNA
agacaacragatgccccctgagg

SEQ ID NO: 1211 - DNA, 23 bp, synthetic construct
  source 1..23: mol_type = other DNA
aaggagrcagaattgaccacggg

SEQ ID NO: 1212 - DNA, 23 bp, synthetic construct
  source 1..23: mol_type = other DNA
caaggagrcagaattgaccacgg

SEQ ID NO: 1213 - DNA, 23 bp, synthetic construct
  source 1..23: mol_type = other DNA
cgccaccrcctacctgtgtgggg

SEQ ID NO: 1214 - DNA, 23 bp, synthetic construct
  source 1..23: mol_type = other DNA
ccgccaccrcctacctgtgtggg

SEQ ID NO: 1215 - DNA, 23 bp, synthetic construct
  source 1..23: mol_type = other DNA
cagcrccgcctacgcccactcgg

SEQ ID NO: 1216 - DNA, 23 bp, synthetic construct
  source 1..23: mol_type = other DNA
ccaatgcccaggtccytgacagc

SEQ ID NO: 1217 - DNA, 23 bp, synthetic construct
  source 1..23: mol_type = other DNA
cccacttcatctggaacygcacg

SEQ ID NO: 1218 - DNA, 23 bp, synthetic construct
  source 1..23: mol_type = other DNA
ccacttcatctggaacygcacgg

SEQ ID NO: 1219 - DNA, 23 bp, synthetic construct
  source 1..23: mol_type = other DNA
ccctgggcatcatccyaggtaat

SEQ ID NO: 1220 - DNA, 23 bp, synthetic construct
  source 1..23: mol_type = other DNA
cctgggcatcatccyaggtaatg

SEQ ID NO: 1221 - DNA, 23 bp, synthetic construct
  source 1..23: mol_type = other DNA
tccagrtaggagccaaaaagagg

SEQ ID NO: 1222 - DNA, 23 bp, synthetic construct
  source 1..23: mol_type = other DNA
cctgatgtgtatgccygggagca

SEQ ID NO: 1223 - DNA, 23 bp, synthetic construct
  source 1..23: mol_type = other DNA
cctcagcacatgtgyaacccaag

SEQ ID NO: 1224 - DNA, 23 bp, synthetic construct
  source 1..23: mol_type = other DNA
gagccccrcctgtccatctatgg

SEQ ID NO: 1225 - DNA, 23 bp, synthetic construct
  source 1..23: mol_type = other DNA
aggcagrcctctgcctgtatggg

SEQ ID NO: 1226 - DNA, 23 bp, synthetic construct
  source 1..23: mol_type = other DNA
gaggcagrcctctgcctgtatgg

SEQ ID NO: 1227 - DNA, 23 bp, synthetic construct
  source 1..23: mol_type = other DNA
ccgagccrggcaggtggaagtgg

SEQ ID NO: 1228 - DNA, 23 bp, synthetic construct
  source 1..23: mol_type = other DNA
ccagctgggcgcctgcctygacc

SEQ ID NO: 1229 - DNA, 23 bp, synthetic construct
  source 1..23: mol_type = other DNA
tcactgrcagacagtggcccagg

SEQ ID NO: 1230 - DNA, 23 bp, synthetic construct
  source 1..23: mol_type = other DNA
ccgatgrtaccagtttcgagtgg

SEQ ID NO: 1231 - DNA, 23 bp, synthetic construct
  source 1..23: mol_type = other DNA
ccgatggtaccagtttygagtgg

SEQ ID NO: 1232 - DNA, 23 bp, synthetic construct
  source 1..23: mol_type = other DNA
cccttcacttcacatygacacat

SEQ ID NO: 1233 - DNA, 23 bp, synthetic construct
  source 1..23: mol_type = other DNA
ccttcacttcacatygacacatg

SEQ ID NO: 1234 - DNA, 23 bp, synthetic construct
  source 1..23: mol_type = other DNA
cccaggctaataggtctygagat

SEQ ID NO: 1235 - DNA, 23 bp, synthetic construct
  source 1..23: mol_type = other DNA
ccaggctaataggtctygagatc

SEQ ID NO: 1236 - DNA, 23 bp, synthetic construct
  source 1..23: mol_type = other DNA
cctaaaataaaatactaytcaca

SEQ ID NO: 1237 - DNA, 23 bp, synthetic construct
  source 1..23: mol_type = other DNA
ccgggcaggcaagacgygcctgg

SEQ ID NO: 1238 - DNA, 23 bp, synthetic construct
  source 1..23: mol_type = other DNA
ccaggtttatctaaagttgygat

SEQ ID NO: 1239 - DNA, 23 bp, synthetic construct
  source 1..23: mol_type = other DNA
ccaggatatggaaaaaygagcac

SEQ ID NO: 1240 - DNA, 23 bp, synthetic construct
  source 1..23: mol_type = other DNA
ccaaatccagcagactgyagggt

SEQ ID NO: 1241 - DNA, 23 bp, synthetic construct
  source 1..23: mol_type = other DNA
ccaaccacattttggacagyagg

SEQ ID NO: 1242 - DNA, 23 bp, synthetic construct
  source 1..23: mol_type = other DNA
ccacattttggacagyaggaatg

SEQ ID NO: 1243 - DNA, 23 bp, synthetic construct
  source 1..23: mol_type = other DNA
acgccraggagctcaaggccagg

SEQ ID NO: 1244 - DNA, 23 bp, synthetic construct
  source 1..23: mol_type = other DNA
cctagaagatacacgagacygaa

SEQ ID NO: 1245 - DNA, 23 bp, synthetic construct
  source 1..23: mol_type = other DNA
tctgcccrtaagcacttggtggg

SEQ ID NO: 1246 - DNA, 23 bp, synthetic construct
  source 1..23: mol_type = other DNA
ctctgcccrtaagcacttggtgg

SEQ ID NO: 1247 - DNA, 23 bp, synthetic construct
  source 1..23: mol_type = other DNA
cagrcggcgcaggcccggctggg

SEQ ID NO: 1248 - DNA, 23 bp, synthetic construct
  source 1..23: mol_type = other DNA
gcagrcggcgcaggcccggctgg

SEQ ID NO: 1249 - DNA, 23 bp, synthetic construct
  source 1..23: mol_type = other DNA
agctgcagrcggcgcaggcccgg

SEQ ID NO: 1250 - DNA, 23 bp, synthetic construct
  source 1..23: mol_type = other DNA
gcagcrccagtgggccgggctgg

SEQ ID NO: 1251 - DNA, 23 bp, synthetic construct
  source 1..23: mol_type = other DNA
catgctcgrccagagcaccgagg

SEQ ID NO: 1252 - DNA, 23 bp, synthetic construct
  source 1..23: mol_type = other DNA
ccgatgacctgcagaagygcctg

SEQ ID NO: 1253 - DNA, 23 bp, synthetic construct
  source 1..23: mol_type = other DNA
cccacctgcgcaagctgygtaag

SEQ ID NO: 1254 - DNA, 23 bp, synthetic construct
  source 1..23: mol_type = other DNA
ccacctgcgcaagctgygtaagc

SEQ ID NO: 1255 - DNA, 23 bp, synthetic construct
  source 1..23: mol_type = other DNA
cctcgcctcccacctgygcaagc

SEQ ID NO: 1256 - DNA, 23 bp, synthetic construct
  source 1..23: mol_type = other DNA
gaaratgtgggttcaaacaaagg

SEQ ID NO: 1257 - DNA, 23 bp, synthetic construct
  source 1..23: mol_type = other DNA
gacartgatcgtcatcaccttgg

SEQ ID NO: 1258 - DNA, 23 bp, synthetic construct
  source 1..23: mol_type = other DNA
tctgtgrgcctcctattccctgg

SEQ ID NO: 1259 - DNA, 23 bp, synthetic construct
  source 1..23: mol_type = other DNA
ccattggctggtcttacygtgga

SEQ ID NO: 1260 - DNA, 23 bp, synthetic construct
  source 1..23: mol_type = other DNA
ccctgggcttcaaataccyggtg

SEQ ID NO: 1261 - DNA, 23 bp, synthetic construct
  source 1..23: mol_type = other DNA
cctgggcttcaaataccyggtgg

SEQ ID NO: 1262 - DNA, 23 bp, synthetic construct
  source 1..23: mol_type = other DNA
ccatgaacccagccygctctttt

SEQ ID NO: 1263 - DNA, 23 bp, synthetic construct
  source 1..23: mol_type = other DNA
atgraagtgcagttagggctggg

SEQ ID NO: 1264 - DNA, 23 bp, synthetic construct
  source 1..23: mol_type = other DNA
gatgraagtgcagttagggctgg

SEQ ID NO: 1265 - DNA, 23 bp, synthetic construct
  source 1..23: mol_type = other DNA
caaggatgraagtgcagttaggg

SEQ ID NO: 1266 - DNA, 23 bp, synthetic construct
  source 1..23: mol_type = other DNA
aagtgrgccaaggccttgcctgg

SEQ ID NO: 1267 - DNA, 23 bp, synthetic construct
  source 1..23: mol_type = other DNA
cttacacrtggacgaccagatgg

SEQ ID NO: 1268 - DNA, 23 bp, synthetic construct
  source 1..23: mol_type = other DNA
ggtaccrcatgcacaagtcccgg

SEQ ID NO: 1269 - DNA, 23 bp, synthetic construct
  source 1..23: mol_type = other DNA
ggccaagrccttgcctggtaagg

SEQ ID NO: 1270 - DNA, 23 bp, synthetic construct
  source 1..23: mol_type = other DNA
ccagggaccatgttttgyccatt

SEQ ID NO: 1271 - DNA, 23 bp, synthetic construct
  source 1..23: mol_type = other DNA
ccgcgaaggacggcaycaaggac

SEQ ID NO: 1272 - DNA, 23 bp, synthetic construct
  source 1..23: mol_type = other DNA
ccagcccggcctgtacccayagc

SEQ ID NO: 1273 - DNA, 23 bp, synthetic construct
  source 1..23: mol_type = other DNA
cccggcctgtacccayagcagcc

SEQ ID NO: 1274 - DNA, 23 bp, synthetic construct
  source 1..23: mol_type = other DNA
ccggcctgtacccayagcagccg

SEQ ID NO: 1275 - DNA, 23 bp, synthetic construct
  source 1..23: mol_type = other DNA
cccaacagcagcatgyaggacat

SEQ ID NO: 1276 - DNA, 23 bp, synthetic construct
  source 1..23: mol_type = other DNA
ccaacagcagcatgyaggacatg

SEQ ID NO: 1277 - DNA, 23 bp, synthetic construct
  source 1..23: mol_type = other DNA
cccctggacctgttcygactcta

SEQ ID NO: 1278 - DNA, 23 bp, synthetic construct
  source 1..23: mol_type = other DNA
ccctggacctgttcygactctac

SEQ ID NO: 1279 - DNA, 23 bp, synthetic construct
  source 1..23: mol_type = other DNA
ccctcctggaactcagcygaggc

SEQ ID NO: 1280 - DNA, 23 bp, synthetic construct
  source 1..23: mol_type = other DNA
cctcctggaactcagcygaggct

SEQ ID NO: 1281 - DNA, 23 bp, synthetic construct
  source 1..23: mol_type = other DNA
ttcaggccrcgggccatttgggg

SEQ ID NO: 1282 - DNA, 23 bp, synthetic construct
  source 1..23: mol_type = other DNA
ggccrgcaagtggcaccttgggg

SEQ ID NO: 1283 - DNA, 23 bp, synthetic construct
  source 1..23: mol_type = other DNA
tggccrgcaagtggcaccttggg

SEQ ID NO: 1284 - DNA, 23 bp, synthetic construct
  source 1..23: mol_type = other DNA
atggccrgcaagtggcaccttgg

SEQ ID NO: 1285 - DNA, 23 bp, synthetic construct
  source 1..23: mol_type = other DNA
cgaccagrtaggaaccacccggg

SEQ ID NO: 1286 - DNA, 23 bp, synthetic construct
  source 1..23: mol_type = other DNA
acgaccagrtaggaaccacccgg

SEQ ID NO: 1287 - DNA, 23 bp, synthetic construct
  source 1..23: mol_type = other DNA
cccaggrtaacccctccccgtgg

SEQ ID NO: 1288 - DNA, 23 bp, synthetic construct
  source 1..23: mol_type = other DNA
gttcrgatgggcatgtaccctgg

SEQ ID NO: 1289 - DNA, 23 bp, synthetic construct
  source 1..23: mol_type = other DNA
atgragctggatgcagctgtggg

SEQ ID NO: 1290 - DNA, 23 bp, synthetic construct
  source 1..23: mol_type = other DNA
gatgragctggatgcagctgtgg

SEQ ID NO: 1291 - DNA, 23 bp, synthetic construct
  source 1..23: mol_type = other DNA
cctggtgcccagctyccgggggg

SEQ ID NO: 1292 - DNA, 23 bp, synthetic construct
  source 1..23: mol_type = other DNA
cctgagggggccttcctgcyccc

SEQ ID NO: 1293 - DNA, 23 bp, synthetic construct
  source 1..23: mol_type = other DNA
cctgcccccaggcgtgayccacg

SEQ ID NO: 1294 - DNA, 23 bp, synthetic construct
  source 1..23: mol_type = other DNA
cccttcttcctgtactatgyctc

SEQ ID NO: 1295 - DNA, 23 bp, synthetic construct
  source 1..23: mol_type = other DNA
ccttcttcctgtactatgyctct

SEQ ID NO: 1296 - DNA, 23 bp, synthetic construct
  source 1..23: mol_type = other DNA
cccagacctgagaccatgygtat

SEQ ID NO: 1297 - DNA, 23 bp, synthetic construct
  source 1..23: mol_type = other DNA
ccagacctgagaccatgygtatg

SEQ ID NO: 1298 - DNA, 23 bp, synthetic construct
  source 1..23: mol_type = other DNA
cccacagtgataccaytgcagac

SEQ ID NO: 1299 - DNA, 23 bp, synthetic construct
  source 1..23: mol_type = other DNA
ccacagtgataccaytgcagacc

SEQ ID NO: 1300 - DNA, 23 bp, synthetic construct
  source 1..23: mol_type = other DNA
cccagrtcccaggaacagcatgg

SEQ ID NO: 1301 - DNA, 23 bp, synthetic construct
  source 1..23: mol_type = other DNA
tcgcrgagccagctgctcactgg

SEQ ID NO: 1302 - DNA, 23 bp, synthetic construct
  source 1..23: mol_type = other DNA
cggtgcctrctatggaagaaagg

SEQ ID NO: 1303 - DNA, 23 bp, synthetic construct
  source 1..23: mol_type = other DNA
ccctgctgtggcccgttcyccct

SEQ ID NO: 1304 - DNA, 23 bp, synthetic construct
  source 1..23: mol_type = other DNA
cctgctgtggcccgttcyccctc

SEQ ID NO: 1305 - DNA, 23 bp, synthetic construct
  source 1..23: mol_type = other DNA
tcggrccaagtggcgcaagcggg

SEQ ID NO: 1306 - DNA, 23 bp, synthetic construct
  source 1..23: mol_type = other DNA
gtcggrccaagtggcgcaagcgg

SEQ ID NO: 1307 - DNA, 23 bp, synthetic construct
  source 1..23: mol_type = other DNA
ccgaggcccgagtcyaggtgagc

SEQ ID NO: 1308 - DNA, 23 bp, synthetic construct
  source 1..23: mol_type = other DNA
ccagaagacgcactaccyggacg

SEQ ID NO: 1309 - DNA, 23 bp, synthetic construct
  source 1..23: mol_type = other DNA
cctcggagcggcagtgttcygac

SEQ ID NO: 1310 - DNA, 23 bp, synthetic construct
  source 1..23: mol_type = other DNA
actcacrttggtcctgaaggagg

SEQ ID NO: 1311 - DNA, 23 bp, synthetic construct
  source 1..23: mol_type = other DNA
ccgatgccgaggccaccacygcc

SEQ ID NO: 1312 - DNA, 23 bp, synthetic construct
  source 1..23: mol_type = other DNA
tggccrgtttgtgggtgcagtgg

SEQ ID NO: 1313 - DNA, 23 bp, synthetic construct
  source 1..23: mol_type = other DNA
gcagaggcrtgagtcctacaggg

SEQ ID NO: 1314 - DNA, 23 bp, synthetic construct
  source 1..23: mol_type = other DNA
cccagatgccattcygccaggcc

SEQ ID NO: 1315 - DNA, 23 bp, synthetic construct
  source 1..23: mol_type = other DNA
ccacgccgtggcactgaccygag

SEQ ID NO: 1316 - DNA, 23 bp, synthetic construct
  source 1..23: mol_type = other DNA
ccgtggcactgaccygagactct

SEQ ID NO: 1317 - DNA, 23 bp, synthetic construct
  source 1..23: mol_type = other DNA
ccacacagccaatgagygccgcc

SEQ ID NO: 1318 - DNA, 23 bp, synthetic construct
  source 1..23: mol_type = other DNA
ccactgacccttctgccygcacg

SEQ ID NO: 1319 - DNA, 23 bp, synthetic construct
  source 1..23: mol_type = other DNA
gcatrgtaaaaactgagtagagg

SEQ ID NO: 1320 - DNA, 23 bp, synthetic construct
  source 1..23: mol_type = other DNA
ccttatagagacatygagctgct

SEQ ID NO: 1321 - DNA, 23 bp, synthetic construct
  source 1..23: mol_type = other DNA
ccttttggctttttcaygagatt

SEQ ID NO: 1322 - DNA, 23 bp, synthetic construct
  source 1..23: mol_type = other DNA
ccaagcagttatttgtatayagt

SEQ ID NO: 1323 - DNA, 23 bp, synthetic construct
  source 1..23: mol_type = other DNA
cccattatcgctgtggcayagtc

SEQ ID NO: 1324 - DNA, 23 bp, synthetic construct
  source 1..23: mol_type = other DNA
ccattatcgctgtggcayagtcc

SEQ ID NO: 1325 - DNA, 23 bp, synthetic construct
  source 1..23: mol_type = other DNA
ccaggctgccattattattyaga

SEQ ID NO: 1326 - DNA, 23 bp, synthetic construct
  source 1..23: mol_type = other DNA
ccactcaaagaaggcygagtaag

SEQ ID NO: 1327 - DNA, 23 bp, synthetic construct
  source 1..23: mol_type = other DNA
caagggccrcaatgacctgatgg

SEQ ID NO: 1328 - DNA, 23 bp, synthetic construct
  source 1..23: mol_type = other DNA
taccrgtgcgtaagactctatgg

SEQ ID NO: 1329 - DNA, 23 bp, synthetic construct
  source 1..23: mol_type = other DNA
cagctacraggctggaatcctgg

SEQ ID NO: 1330 - DNA, 23 bp, synthetic construct
  source 1..23: mol_type = other DNA
cgtgggccrtattgacatcgtgg

SEQ ID NO: 1331 - DNA, 23 bp, synthetic construct
  source 1..23: mol_type = other DNA
ccaagtcccaggagygagtggaa

SEQ ID NO: 1332 - DNA, 23 bp, synthetic construct
  source 1..23: mol_type = other DNA
cctcgactcccgccagaygctat

SEQ ID NO: 1333 - DNA, 23 bp, synthetic construct
  source 1..23: mol_type = other DNA
ccaggtgtacatcctcggcyggg

SEQ ID NO: 1334 - DNA, 23 bp, synthetic construct
  source 1..23: mol_type = other DNA
ccttcaccatggacygggaagtg

SEQ ID NO: 1335 - DNA, 23 bp, synthetic construct
  source 1..23: mol_type = other DNA
ccagccacccgacagygagatgg

SEQ ID NO: 1336 - DNA, 23 bp, synthetic construct
  source 1..23: mol_type = other DNA
ccatctgttgagcccyaggttgg

SEQ ID NO: 1337 - DNA, 23 bp, synthetic construct
  source 1..23: mol_type = other DNA
ccttggcagaacaayagccaaaa

SEQ ID NO: 1338 - DNA, 23 bp, synthetic construct
  source 1..23: mol_type = other DNA
ccgcttgtcagtctygcaagaag

SEQ ID NO: 1339 - DNA, 23 bp, synthetic construct
  source 1..23: mol_type = other DNA
ccaaattcttggaaaaaygcctc

SEQ ID NO: 1340 - DNA, 23 bp, synthetic construct
  source 1..23: mol_type = other DNA
cctttgatagtcagtcaaytttg

SEQ ID NO: 1341 - DNA, 23 bp, synthetic construct
  source 1..23: mol_type = other DNA
tgaattrggatgctgtttttagg

SEQ ID NO: 1342 - DNA, 23 bp, synthetic construct
  source 1..23: mol_type = other DNA
cctttgaagcttcagyaaacagc

SEQ ID NO: 1343 - DNA, 23 bp, synthetic construct
  source 1..23: mol_type = other DNA
ataccrcagcacccgcttctggg

SEQ ID NO: 1344 - DNA, 23 bp, synthetic construct
  source 1..23: mol_type = other DNA
aataccrcagcacccgcttctgg

SEQ ID NO: 1345 - DNA, 23 bp, synthetic construct
  source 1..23: mol_type = other DNA
gggagcrtgtgctgggtgagagg

SEQ ID NO: 1346 - DNA, 23 bp, synthetic construct
  source 1..23: mol_type = other DNA
cctggaggcggtggagaygctgg

SEQ ID NO: 1347 - DNA, 23 bp, synthetic construct
  source 1..23: mol_type = other DNA
ccctccgcatgtaccygctcaag

SEQ ID NO: 1348 - DNA, 23 bp, synthetic construct
  source 1..23: mol_type = other DNA
cctccgcatgtaccygctcaagt

SEQ ID NO: 1349 - DNA, 23 bp, synthetic construct
  source 1..23: mol_type = other DNA
ccatctgctcggacaagaygggc

SEQ ID NO: 1350 - DNA, 23 bp, synthetic construct
  source 1..23: mol_type = other DNA
ccggcgatcaccccatcayggcc

SEQ ID NO: 1351 - DNA, 23 bp, synthetic construct
  source 1..23: mol_type = other DNA
cccgttcctgaccccygagctgt

SEQ ID NO: 1352 - DNA, 23 bp, synthetic construct
  source 1..23: mol_type = other DNA
ccgttcctgaccccygagctgtc

SEQ ID NO: 1353 - DNA, 23 bp, synthetic construct
  source 1..23: mol_type = other DNA
cctgaggccctgatccyggtgca

SEQ ID NO: 1354 - DNA, 23 bp, synthetic construct
  source 1..23: mol_type = other DNA
cgtcrgggaagttgtctggtagg

SEQ ID NO: 1355 - DNA, 23 bp, synthetic construct
  source 1..23: mol_type = other DNA
ccaacgtcrgggaagttgtctgg

SEQ ID NO: 1356 - DNA, 23 bp, synthetic construct
  source 1..23: mol_type = other DNA
tacggrgctgagcctggaacagg

SEQ ID NO: 1357 - DNA, 23 bp, synthetic construct
  source 1..23: mol_type = other DNA
gctgtarcagcaattcctgaagg

SEQ ID NO: 1358 - DNA, 23 bp, synthetic construct
  source 1..23: mol_type = other DNA
ccttttagtcttgayagtgttgc

SEQ ID NO: 1359 - DNA, 23 bp, synthetic construct
  source 1..23: mol_type = other DNA
ggaartaagtgtcccatagctgg

SEQ ID NO: 1360 - DNA, 23 bp, synthetic construct
  source 1..23: mol_type = other DNA
tgcractgcactggtaaggatgg

SEQ ID NO: 1361 - DNA, 23 bp, synthetic construct
  source 1..23: mol_type = other DNA
gccctgcractgcactggtaagg

SEQ ID NO: 1362 - DNA, 23 bp, synthetic construct
  source 1..23: mol_type = other DNA
cctcagcctggctcatgcaygtg

SEQ ID NO: 1363 - DNA, 23 bp, synthetic construct
  source 1..23: mol_type = other DNA
cccgtttgggattgatcyggtaa

SEQ ID NO: 1364 - DNA, 23 bp, synthetic construct
  source 1..23: mol_type = other DNA
ccgtttgggattgatcyggtaat

SEQ ID NO: 1365 - DNA, 23 bp, synthetic construct
  source 1..23: mol_type = other DNA
gagcrggcaggtgcttgaggtgg

SEQ ID NO: 1366 - DNA, 23 bp, synthetic construct
  source 1..23: mol_type = other DNA
gaggagcrggcaggtgcttgagg

SEQ ID NO: 1367 - DNA, 23 bp, synthetic construct
  source 1..23: mol_type = other DNA
cctcagcgaattttaccctygag

SEQ ID NO: 1368 - DNA, 23 bp, synthetic construct
  source 1..23: mol_type = other DNA
ccaagcctctatcayagttctgt

SEQ ID NO: 1369 - DNA, 23 bp, synthetic construct
  source 1..23: mol_type = other DNA
cgtgrgcgtggccagccccaggg

SEQ ID NO: 1370 - DNA, 23 bp, synthetic construct
  source 1..23: mol_type = other DNA
ccgtgrgcgtggccagccccagg

SEQ ID NO: 1371 - DNA, 23 bp, synthetic construct
  source 1..23: mol_type = other DNA
gtaatcrgttttatcgattttgg

SEQ ID NO: 1372 - DNA, 23 bp, synthetic construct
  source 1..23: mol_type = other DNA
gggccggtrgctggaacacttgg

SEQ ID NO: 1373 - DNA, 23 bp, synthetic construct
  source 1..23: mol_type = other DNA
tcctrtaagttgaatgccttggg

SEQ ID NO: 1374 - DNA, 23 bp, synthetic construct
  source 1..23: mol_type = other DNA
ttcctrtaagttgaatgccttgg

SEQ ID NO: 1375 - DNA, 23 bp, synthetic construct
  source 1..23: mol_type = other DNA
ccggaacccaagttcrtcacgtt

SEQ ID NO: 1376 - DNA, 23 bp, synthetic construct
  source 1..23: mol_type = other DNA
cccggaagcactgtaattgyggg

SEQ ID NO: 1377 - DNA, 23 bp, synthetic construct
  source 1..23: mol_type = other DNA
ccggaagcactgtaattgygggg

SEQ ID NO: 1378 - DNA, 23 bp, synthetic construct
  source 1..23: mol_type = other DNA
ctctcccratgaaggtgccctgg

SEQ ID NO: 1379 - DNA, 23 bp, synthetic construct
  source 1..23: mol_type = other DNA
aggargaggattattttaacagg

SEQ ID NO: 1380 - DNA, 23 bp, synthetic construct
  source 1..23: mol_type = other DNA
ccaggagcttgatgttaaaygaa

SEQ ID NO: 1381 - DNA, 23 bp, synthetic construct
  source 1..23: mol_type = other DNA
ctcargtcgatttagtaacaggg

SEQ ID NO: 1382 - DNA, 23 bp, synthetic construct
  source 1..23: mol_type = other DNA
tctcargtcgatttagtaacagg

SEQ ID NO: 1383 - DNA, 23 bp, synthetic construct
  source 1..23: mol_type = other DNA
ctctrctatgagctgctggtggg

SEQ ID NO: 1384 - DNA, 23 bp, synthetic construct
  source 1..23: mol_type = other DNA
gctctrctatgagctgctggtgg

SEQ ID NO: 1385 - DNA, 23 bp, synthetic construct
  source 1..23: mol_type = other DNA
agtgctctrctatgagctgctgg

SEQ ID NO: 1386 - DNA, 23 bp, synthetic construct
  source 1..23: mol_type = other DNA
agtccrgccagaaggcgtgcggg

SEQ ID NO: 1387 - DNA, 23 bp, synthetic construct
  source 1..23: mol_type = other DNA
cagtccrgccagaaggcgtgcgg

SEQ ID NO: 1388 - DNA, 23 bp, synthetic construct
  source 1..23: mol_type = other DNA
ccgtcgccctgccagtycggcca

SEQ ID NO: 1389 - DNA, 23 bp, synthetic construct
  source 1..23: mol_type = other DNA
cctgacaccatgctgcycgcctg

SEQ ID NO: 1390 - DNA, 23 bp, synthetic construct
  source 1..23: mol_type = other DNA
ccagatgccctgtgtygggccgt

SEQ ID NO: 1391 - DNA, 23 bp, synthetic construct
  source 1..23: mol_type = other DNA
cctggaaggccaccgacygcttc

SEQ ID NO: 1392 - DNA, 23 bp, synthetic construct
  source 1..23: mol_type = other DNA
atctgtgrgggggcaacagcggg

SEQ ID NO: 1393 - DNA, 23 bp, synthetic construct
  source 1..23: mol_type = other DNA
catctgtgrgggggcaacagcgg

SEQ ID NO: 1394 - DNA, 23 bp, synthetic construct
  source 1..23: mol_type = other DNA
ccgctcgtctccaggcgaaygag

SEQ ID NO: 1395 - DNA, 23 bp, synthetic construct
  source 1..23: mol_type = other DNA
ggtrtggagggagttgcaggtgg

SEQ ID NO: 1396 - DNA, 23 bp, synthetic construct
  source 1..23: mol_type = other DNA
gaaggtrtggagggagttgcagg

SEQ ID NO: 1397 - DNA, 23 bp, synthetic construct
  source 1..23: mol_type = other DNA
cgcccrccgcagcagcttcatgg

SEQ ID NO: 1398 - DNA, 23 bp, synthetic construct
  source 1..23: mol_type = other DNA
ccgagagcacgtagcygccgccc

SEQ ID NO: 1399 - DNA, 23 bp, synthetic construct
  source 1..23: mol_type = other DNA
gtgcrtcaggccaggagagacgg

SEQ ID NO: 1400 - DNA, 23 bp, synthetic construct
  source 1..23: mol_type = other DNA
ccaatggcccttccygggagggc

SEQ ID NO: 1401 - DNA, 23 bp, synthetic construct
  source 1..23: mol_type = other DNA
cttcgtgrcagagcccatggggg

SEQ ID NO: 1402 - DNA, 23 bp, synthetic construct
  source 1..23: mol_type = other DNA
acttcgtgrcagagcccatgggg

SEQ ID NO: 1403 - DNA, 23 bp, synthetic construct
  source 1..23: mol_type = other DNA
tctgraaggctccttcgagctgg

SEQ ID NO: 1404 - DNA, 23 bp, synthetic construct
  source 1..23: mol_type = other DNA
aagagrtaaataaataacatggg

SEQ ID NO: 1405 - DNA, 23 bp, synthetic construct
  source 1..23: mol_type = other DNA
aaagagrtaaataaataacatgg

SEQ ID NO: 1406 - DNA, 23 bp, synthetic construct
  source 1..23: mol_type = other DNA
ccttctgttcagtcyggggctac

SEQ ID NO: 1407 - DNA, 23 bp, synthetic construct
  source 1..23: mol_type = other DNA
cccatgtatggcagtygatttgg

SEQ ID NO: 1408 - DNA, 23 bp, synthetic construct
  source 1..23: mol_type = other DNA
ccatgtatggcagtygatttggt

SEQ ID NO: 1409 - DNA, 23 bp, synthetic construct
  source 1..23: mol_type = other DNA
ccttttgtttgggayatcagacg

SEQ ID NO: 1410 - DNA, 23 bp, synthetic construct
  source 1..23: mol_type = other DNA
cccaggtgggcgacgagygagac

SEQ ID NO: 1411 - DNA, 23 bp, synthetic construct
  source 1..23: mol_type = other DNA
ccaggtgggcgacgagygagact

SEQ ID NO: 1412 - DNA, 23 bp, synthetic construct
  source 1..23: mol_type = other DNA
cctgcagcggtgggggcggygta

SEQ ID NO: 1413 - DNA, 23 bp, synthetic construct
  source 1..23: mol_type = other DNA
cccccacgtgagaggyggcctcc

SEQ ID NO: 1414 - DNA, 23 bp, synthetic construct
  source 1..23: mol_type = other DNA
ccccacgtgagaggyggcctccc

SEQ ID NO: 1415 - DNA, 23 bp, synthetic construct
  source 1..23: mol_type = other DNA
cctctccactggccaygcagatc

SEQ ID NO: 1416 - DNA, 23 bp, synthetic construct
  source 1..23: mol_type = other DNA
ccccatcatcttcttctgcygga

SEQ ID NO: 1417 - DNA, 23 bp, synthetic construct
  source 1..23: mol_type = other DNA
cccatcatcttcttctgcyggaa

SEQ ID NO: 1418 - DNA, 23 bp, synthetic construct
  source 1..23: mol_type = other DNA
ccatcatcttcttctgcyggaac

SEQ ID NO: 1419 - DNA, 23 bp, synthetic construct
  source 1..23: mol_type = other DNA
ttcartctgtgatcaaaacaggg

SEQ ID NO: 1420 - DNA, 23 bp, synthetic construct
  source 1..23: mol_type = other DNA
tttcartctgtgatcaaaacagg

SEQ ID NO: 1421 - DNA, 23 bp, synthetic construct
  source 1..23: mol_type = other DNA
cctgaagcattttttgccyattg

SEQ ID NO: 1422 - DNA, 23 bp, synthetic construct
  source 1..23: mol_type = other DNA
ccagtactgccagctggtgygac

SEQ ID NO: 1423 - DNA, 23 bp, synthetic construct
  source 1..23: mol_type = other DNA
gcagarcctggtactcctggagg

SEQ ID NO: 1424 - DNA, 23 bp, synthetic construct
  source 1..23: mol_type = other DNA
gcagcagarcctggtactcctgg

SEQ ID NO: 1425 - DNA, 23 bp, synthetic construct
  source 1..23: mol_type = other DNA
ccctttggctatccacgcygccg

SEQ ID NO: 1426 - DNA, 23 bp, synthetic construct
  source 1..23: mol_type = other DNA
cctttggctatccacgcygccgg

SEQ ID NO: 1427 - DNA, 23 bp, synthetic construct
  source 1..23: mol_type = other DNA
caartggctaatgcccgcttagg

SEQ ID NO: 1428 - DNA, 23 bp, synthetic construct
  source 1..23: mol_type = other DNA
ccagrtgtccctgttggctgtgg

SEQ ID NO: 1429 - DNA, 23 bp, synthetic construct
  source 1..23: mol_type = other DNA
cccaggtggtgactgtggyggtg

SEQ ID NO: 1430 - DNA, 23 bp, synthetic construct
  source 1..23: mol_type = other DNA
ccaggtggtgactgtggyggtgt

SEQ ID NO: 1431 - DNA, 23 bp, synthetic construct
  source 1..23: mol_type = other DNA
cctgacttgtctagttgggyggc

SEQ ID NO: 1432 - DNA, 23 bp, synthetic construct
  source 1..23: mol_type = other DNA
cctgatccaggagtyggcctcca

SEQ ID NO: 1433 - DNA, 23 bp, synthetic construct
  source 1..23: mol_type = other DNA
ctgraaccagcacaaggagctgg

SEQ ID NO: 1434 - DNA, 23 bp, synthetic construct
  source 1..23: mol_type = other DNA
ctacaccrctatgaatgatcggg

SEQ ID NO: 1435 - DNA, 23 bp, synthetic construct
  source 1..23: mol_type = other DNA
actacaccrctatgaatgatcgg

SEQ ID NO: 1436 - DNA, 23 bp, synthetic construct
  source 1..23: mol_type = other DNA
tgataattrctgtaaaacaaagg

SEQ ID NO: 1437 - DNA, 23 bp, synthetic construct
  source 1..23: mol_type = other DNA
cctagggcattcactgyggtaca

SEQ ID NO: 1438 - DNA, 23 bp, synthetic construct
  source 1..23: mol_type = other DNA
ccgttttatgtgtcagyagcaaa

SEQ ID NO: 1439 - DNA, 23 bp, synthetic construct
  source 1..23: mol_type = other DNA
cccctttccactggytgaccacc

SEQ ID NO: 1440 - DNA, 23 bp, synthetic construct
  source 1..23: mol_type = other DNA
agttrctgcattgctgacctggg

SEQ ID NO: 1441 - DNA, 23 bp, synthetic construct
  source 1..23: mol_type = other DNA
gagttrctgcattgctgacctgg

SEQ ID NO: 1442 - DNA, 23 bp, synthetic construct
  source 1..23: mol_type = other DNA
cccgcaattgctcatygagacct

SEQ ID NO: 1443 - DNA, 23 bp, synthetic construct
  source 1..23: mol_type = other DNA
ccgcaattgctcatygagaccta

SEQ ID NO: 1444 - DNA, 23 bp, synthetic construct
  source 1..23: mol_type = other DNA
acctrtgttattagtgactttgg

SEQ ID NO: 1445 - DNA, 23 bp, synthetic construct
  source 1..23: mol_type = other DNA
ccaggatgcagaggctyggctta

SEQ ID NO: 1446 - DNA, 23 bp, synthetic construct
  source 1..23: mol_type = other DNA
cctgcaatttcccatygagattt

SEQ ID NO: 1447 - DNA, 23 bp, synthetic construct
  source 1..23: mol_type = other DNA
ccgtaccagagtacyagatggct

SEQ ID NO: 1448 - DNA, 23 bp, synthetic construct
  source 1..23: mol_type = other DNA
cctggcgtctaaatgagygtcac

SEQ ID NO: 1449 - DNA, 23 bp, synthetic construct
  source 1..23: mol_type = other DNA
ccaagtcaatcatcyacagagac

SEQ ID NO: 1450 - DNA, 23 bp, synthetic construct
  source 1..23: mol_type = other DNA
gatgcctgracagaggacaatgg

SEQ ID NO: 1451 - DNA, 23 bp, synthetic construct
  source 1..23: mol_type = other DNA
gtcagargagatgtggtcaatgg

SEQ ID NO: 1452 - DNA, 23 bp, synthetic construct
  source 1..23: mol_type = other DNA
gatgcctrgacagaggacaatgg

SEQ ID NO: 1453 - DNA, 23 bp, synthetic construct
  source 1..23: mol_type = other DNA
gaatrgatggtacagctgtgtgg

SEQ ID NO: 1454 - DNA, 23 bp, synthetic construct
  source 1..23: mol_type = other DNA
gaatgratggtacagctgtgtgg

SEQ ID NO: 1455 - DNA, 23 bp, synthetic construct
  source 1..23: mol_type = other DNA
taacagatrggctggaagtaagg

SEQ ID NO: 1456 - DNA, 23 bp, synthetic construct
  source 1..23: mol_type = other DNA
ttcaragggaaccccttacctgg

SEQ ID NO: 1457 - DNA, 23 bp, synthetic construct
  source 1..23: mol_type = other DNA
tttaargtgaagcagcatctggg

SEQ ID NO: 1458 - DNA, 23 bp, synthetic construct
  source 1..23: mol_type = other DNA
atttaargtgaagcagcatctgg

SEQ ID NO: 1459 - DNA, 23 bp, synthetic construct
  source 1..23: mol_type = other DNA
cccatacacatttggctyagggt

SEQ ID NO: 1460 - DNA, 23 bp, synthetic construct
  source 1..23: mol_type = other DNA
ccatacacatttggctyagggtt

SEQ ID NO: 1461 - DNA, 23 bp, synthetic construct
  source 1..23: mol_type = other DNA
ccaaacggagcagaatggtyaag

SEQ ID NO: 1462 - DNA, 23 bp, synthetic construct
  source 1..23: mol_type = other DNA
cctgaaataaaaaagyaagaata

SEQ ID NO: 1463 - DNA, 23 bp, synthetic construct
  source 1..23: mol_type = other DNA
ccaccaaggtccaaagygagcaa

SEQ ID NO: 1464 - DNA, 23 bp, synthetic construct
  source 1..23: mol_type = other DNA
cctggcttagcaaggagcyaaca

SEQ ID NO: 1465 - DNA, 23 bp, synthetic construct
  source 1..23: mol_type = other DNA
ccgtgccaaaagacttctayaga

SEQ ID NO: 1466 - DNA, 23 bp, synthetic construct
  source 1..23: mol_type = other DNA
ccaaaagacttctayagagtgaa

SEQ ID NO: 1467 - DNA, 23 bp, synthetic construct
  source 1..23: mol_type = other DNA
ccagaagaaagggccttcayagt

SEQ ID NO: 1468 - DNA, 23 bp, synthetic construct
  source 1..23: mol_type = other DNA
tagatrgatcatatggaaactgg

SEQ ID NO: 1469 - DNA, 23 bp, synthetic construct
  source 1..23: mol_type = other DNA
aacaaatrggcaggactcttagg

SEQ ID NO: 1470 - DNA, 23 bp, synthetic construct
  source 1..23: mol_type = other DNA
aacaaatgrgcaggactcttagg

SEQ ID NO: 1471 - DNA, 23 bp, synthetic construct
  source 1..23: mol_type = other DNA
catatrgaaactggcagctatgg

SEQ ID NO: 1472 - DNA, 23 bp, synthetic construct
  source 1..23: mol_type = other DNA
gttttrgatagaccttaatgagg

SEQ ID NO: 1473 - DNA, 23 bp, synthetic construct
  source 1..23: mol_type = other DNA
ccttgargtgagagagtaagagg

SEQ ID NO: 1474 - DNA, 23 bp, synthetic construct
  source 1..23: mol_type = other DNA
agatgggtrgtatgctgttaagg

SEQ ID NO: 1475 - DNA, 23 bp, synthetic construct
  source 1..23: mol_type = other DNA
ccatggaatctgctgaayaaaag

SEQ ID NO: 1476 - DNA, 23 bp, synthetic construct
  source 1..23: mol_type = other DNA
ccaataatattcaaagagyaagg

SEQ ID NO: 1477 - DNA, 23 bp, synthetic construct
  source 1..23: mol_type = other DNA
ccataatttaacacctagcyaaa

SEQ ID NO: 1478 - DNA, 23 bp, synthetic construct
  source 1..23: mol_type = other DNA
ccagaacatttaatatccyaaaa

SEQ ID NO: 1479 - DNA, 23 bp, synthetic construct
  source 1..23: mol_type = other DNA
cctaggcacaataaaagatygaa

SEQ ID NO: 1480 - DNA, 23 bp, synthetic construct
  source 1..23: mol_type = other DNA
ccttattcactaaaattyaggag

SEQ ID NO: 1481 - DNA, 23 bp, synthetic construct
  source 1..23: mol_type = other DNA
ccaagctacatattgyagaagag

SEQ ID NO: 1482 - DNA, 23 bp, synthetic construct
  source 1..23: mol_type = other DNA
cccagaaagggtgcttcttyaac

SEQ ID NO: 1483 - DNA, 23 bp, synthetic construct
  source 1..23: mol_type = other DNA
ccagaaagggtgcttcttyaact

SEQ ID NO: 1484 - DNA, 23 bp, synthetic construct
  source 1..23: mol_type = other DNA
cctatttaaaactccayaaagga

SEQ ID NO: 1485 - DNA, 23 bp, synthetic construct
  source 1..23: mol_type = other DNA
ttctttargactttctaaatggg

SEQ ID NO: 1486 - DNA, 23 bp, synthetic construct
  source 1..23: mol_type = other DNA
tttctttargactttctaaatgg

SEQ ID NO: 1487 - DNA, 23 bp, synthetic construct
  source 1..23: mol_type = other DNA
agtgcatrgaattgctagatggg

SEQ ID NO: 1488 - DNA, 23 bp, synthetic construct
  source 1..23: mol_type = other DNA
aagtgcatrgaattgctagatgg

SEQ ID NO: 1489 - DNA, 23 bp, synthetic construct
  source 1..23: mol_type = other DNA
ccaaatgtgaaagatctayaggt

SEQ ID NO: 1490 - DNA, 23 bp, synthetic construct
  source 1..23: mol_type = other DNA
ccatattacacagccygagaact

SEQ ID NO: 1491 - DNA, 23 bp, synthetic construct
  source 1..23: mol_type = other DNA
ggatcrgcttcattgtgctgggg

SEQ ID NO: 1492 - DNA, 23 bp, synthetic construct
  source 1..23: mol_type = other DNA
cggatcrgcttcattgtgctggg

SEQ ID NO: 1493 - DNA, 23 bp, synthetic construct
  source 1..23: mol_type = other DNA
ccggatcrgcttcattgtgctgg

SEQ ID NO: 1494 - DNA, 23 bp, synthetic construct
  source 1..23: mol_type = other DNA
tggtgatcrggggcatcatctgg

SEQ ID NO: 1495 - DNA, 23 bp, synthetic construct
  source 1..23: mol_type = other DNA
gctccagcrcctgagttgtatgg

SEQ ID NO: 1496 - DNA, 23 bp, synthetic construct
  source 1..23: mol_type = other DNA
aagtrgcatacacacccctctgg

SEQ ID NO: 1497 - DNA, 23 bp, synthetic construct
  source 1..23: mol_type = other DNA
catcagccrccaagaggccttgg

SEQ ID NO: 1498 - DNA, 23 bp, synthetic construct
  source 1..23: mol_type = other DNA
aatgtcrtgttcagcaataatgg

SEQ ID NO: 1499 - DNA, 23 bp, synthetic construct
  source 1..23: mol_type = other DNA
gatrggcttcacacagtacatgg

SEQ ID NO: 1500 - DNA, 23 bp, synthetic construct
  source 1..23: mol_type = other DNA
ctatgrgcgcttgtatgagaggg

SEQ ID NO: 1501 - DNA, 23 bp, synthetic construct
  source 1..23: mol_type = other DNA
tctatgrgcgcttgtatgagagg

SEQ ID NO: 1502 - DNA, 23 bp, synthetic construct
  source 1..23: mol_type = other DNA
ctatgggcrcttgtatgagaggg

SEQ ID NO: 1503 - DNA, 23 bp, synthetic construct
  source 1..23: mol_type = other DNA
tcaccrcttcaatgacacagagg

SEQ ID NO: 1504 - DNA, 23 bp, synthetic construct
  source 1..23: mol_type = other DNA
ccacaccrgggaggagagcgtgg

SEQ ID NO: 1505 - DNA, 23 bp, synthetic construct
  source 1..23: mol_type = other DNA
tccaartgtgtgccctggtcagg

SEQ ID NO: 1506 - DNA, 23 bp, synthetic construct
  source 1..23: mol_type = other DNA
aagtgrcatacacacccctctgg

SEQ ID NO: 1507 - DNA, 23 bp, synthetic construct
  source 1..23: mol_type = other DNA
ccctctggctctcatcagcygcc

SEQ ID NO: 1508 - DNA, 23 bp, synthetic construct
  source 1..23: mol_type = other DNA
cctctggctctcatcagcygcca

SEQ ID NO: 1509 - DNA, 23 bp, synthetic construct
  source 1..23: mol_type = other DNA
cctctgggctggtgayggcggct

SEQ ID NO: 1510 - DNA, 23 bp, synthetic construct
  source 1..23: mol_type = other DNA
ccttgacatctatgaayagcaag

SEQ ID NO: 1511 - DNA, 23 bp, synthetic construct
  source 1..23: mol_type = other DNA
cctctaggtgctccagygcctga

SEQ ID NO: 1512 - DNA, 23 bp, synthetic construct
  source 1..23: mol_type = other DNA
cctgagttgtatggycatcaggg

SEQ ID NO: 1513 - DNA, 23 bp, synthetic construct
  source 1..23: mol_type = other DNA
cccttgttgaccgctacygtaaa

SEQ ID NO: 1514 - DNA, 23 bp, synthetic construct
  source 1..23: mol_type = other DNA
ccttgttgaccgctacygtaaac

SEQ ID NO: 1515 - DNA, 23 bp, synthetic construct
  source 1..23: mol_type = other DNA
cccaagrcctacgtctctacagg

SEQ ID NO: 1516 - DNA, 23 bp, synthetic construct
  source 1..23: mol_type = other DNA
ccaaacacatgactyggagtcag

SEQ ID NO: 1517 - DNA, 23 bp, synthetic construct
  source 1..23: mol_type = other DNA
ccaaatttccagtcyggtggtcc

SEQ ID NO: 1518 - DNA, 23 bp, synthetic construct
  source 1..23: mol_type = other DNA
ccatggtggagagcaygagataa

SEQ ID NO: 1519 - DNA, 23 bp, synthetic construct
  source 1..23: mol_type = other DNA
ggcrgattgtattctggttgggg

SEQ ID NO: 1520 - DNA, 23 bp, synthetic construct
  source 1..23: mol_type = other DNA
cggcrgattgtattctggttggg

SEQ ID NO: 1521 - DNA, 23 bp, synthetic construct
  source 1..23: mol_type = other DNA
ccggcrgattgtattctggttgg

SEQ ID NO: 1522 - DNA, 23 bp, synthetic construct
  source 1..23: mol_type = other DNA
cccgggtcatgctgayacagttt

SEQ ID NO: 1523 - DNA, 23 bp, synthetic construct
  source 1..23: mol_type = other DNA
ccgggtcatgctgayacagtttg

SEQ ID NO: 1524 - DNA, 23 bp, synthetic construct
  source 1..23: mol_type = other DNA
cccgtggccacgcagatcyagca

SEQ ID NO: 1525 - DNA, 23 bp, synthetic construct
  source 1..23: mol_type = other DNA
ccgtggccacgcagatcyagcag

SEQ ID NO: 1526 - DNA, 23 bp, synthetic construct
  source 1..23: mol_type = other DNA
cctgttcacaaagaaaaaygaga

SEQ ID NO: 1527 - DNA, 23 bp, synthetic construct
  source 1..23: mol_type = other DNA
ccctcgaaggcccgccaygatga

SEQ ID NO: 1528 - DNA, 23 bp, synthetic construct
  source 1..23: mol_type = other DNA
cctcgaaggcccgccaygatgac

SEQ ID NO: 1529 - DNA, 23 bp, synthetic construct
  source 1..23: mol_type = other DNA
actcrgacaagtacacaagtggg

SEQ ID NO: 1530 - DNA, 23 bp, synthetic construct
  source 1..23: mol_type = other DNA
cactcrgacaagtacacaagtgg

SEQ ID NO: 1531 - DNA, 23 bp, synthetic construct
  source 1..23: mol_type = other DNA
cctggggaaaacctggggayagg

SEQ ID NO: 1532 - DNA, 23 bp, synthetic construct
  source 1..23: mol_type = other DNA
tctggtcraaaagtcacatttgg

SEQ ID NO: 1533 - DNA, 23 bp, synthetic construct
  source 1..23: mol_type = other DNA
ctgggacrcttcttcttctctgg

SEQ ID NO: 1534 - DNA, 23 bp, synthetic construct
  source 1..23: mol_type = other DNA
cctggccctctccgcggcgyggc

SEQ ID NO: 1535 - DNA, 23 bp, synthetic construct
  source 1..23: mol_type = other DNA
ccctctccgcggcgyggccatcg

SEQ ID NO: 1536 - DNA, 23 bp, synthetic construct
  source 1..23: mol_type = other DNA
cccgagcaagtgattacytttaa

SEQ ID NO: 1537 - DNA, 23 bp, synthetic construct
  source 1..23: mol_type = other DNA
ccgagcaagtgattacytttaaa

SEQ ID NO: 1538 - DNA, 23 bp, synthetic construct
  source 1..23: mol_type = other DNA
actgggaarggcccaacaacggg

SEQ ID NO: 1539 - DNA, 23 bp, synthetic construct
  source 1..23: mol_type = other DNA
tccrcctcttccgagctgcccgg

SEQ ID NO: 1540 - DNA, 23 bp, synthetic construct
  source 1..23: mol_type = other DNA
aatrtcagccctactgggaaggg

SEQ ID NO: 1541 - DNA, 23 bp, synthetic construct
  source 1..23: mol_type = other DNA
aaatrtcagccctactgggaagg

SEQ ID NO: 1542 - DNA, 23 bp, synthetic construct
  source 1..23: mol_type = other DNA
gaccaaatrtcagccctactggg

SEQ ID NO: 1543 - DNA, 23 bp, synthetic construct
  source 1..23: mol_type = other DNA
cccctttcagatcctgaygggcg

SEQ ID NO: 1544 - DNA, 23 bp, synthetic construct
  source 1..23: mol_type = other DNA
ccctttcagatcctgaygggcga

SEQ ID NO: 1545 - DNA, 23 bp, synthetic construct
  source 1..23: mol_type = other DNA
cctttcagatcctgaygggcgaa

SEQ ID NO: 1546 - DNA, 23 bp, synthetic construct
  source 1..23: mol_type = other DNA
cccttacaggtgctgygatactt

SEQ ID NO: 1547 - DNA, 23 bp, synthetic construct
  source 1..23: mol_type = other DNA
ccttacaggtgctgygatacttt

SEQ ID NO: 1548 - DNA, 23 bp, synthetic construct
  source 1..23: mol_type = other DNA
ccaagccgctgaccygacacatg

SEQ ID NO: 1549 - DNA, 23 bp, synthetic construct
  source 1..23: mol_type = other DNA
cccttgcgaggagacttaygtga

SEQ ID NO: 1550 - DNA, 23 bp, synthetic construct
  source 1..23: mol_type = other DNA
ccttgcgaggagacttaygtgaa

SEQ ID NO: 1551 - DNA, 23 bp, synthetic construct
  source 1..23: mol_type = other DNA
tggttctcrgtgtgcttagcggg

SEQ ID NO: 1552 - DNA, 23 bp, synthetic construct
  source 1..23: mol_type = other DNA
ttagcrggtaagcaggaccaagg

SEQ ID NO: 1553 - DNA, 23 bp, synthetic construct
  source 1..23: mol_type = other DNA
tggttctcrgtgtgttgagcggg

SEQ ID NO: 1554 - DNA, 23 bp, synthetic construct
  source 1..23: mol_type = other DNA
ttgrcgtcctgagtgggtgaggg

SEQ ID NO: 1555 - DNA, 23 bp, synthetic construct
  source 1..23: mol_type = other DNA
cttgrcgtcctgagtgggtgagg

SEQ ID NO: 1556 - DNA, 23 bp, synthetic construct
  source 1..23: mol_type = other DNA
ccgctgaggaccccatcygagcc

SEQ ID NO: 1557 - DNA, 23 bp, synthetic construct
  source 1..23: mol_type = other DNA
tccrctgcatccgcctcctgagg

SEQ ID NO: 1558 - DNA, 23 bp, synthetic construct
  source 1..23: mol_type = other DNA
ccttatagctcctcaaaytaaat

SEQ ID NO: 1559 - DNA, 23 bp, synthetic construct
  source 1..23: mol_type = other DNA
ccgctcttcctcctyagccccac

SEQ ID NO: 1560 - DNA, 23 bp, synthetic construct
  source 1..23: mol_type = other DNA
cctgccgcrccgcgccagccagg

SEQ ID NO: 1561 - DNA, 23 bp, synthetic construct
  source 1..23: mol_type = other DNA
ccgcgggcgcagtcactcayccg

SEQ ID NO: 1562 - DNA, 23 bp, synthetic construct
  source 1..23: mol_type = other DNA
ccttgcccaggccgcccaygtac

SEQ ID NO: 1563 - DNA, 23 bp, synthetic construct
  source 1..23: mol_type = other DNA
cctgatgcagaagaaccggygga

SEQ ID NO: 1564 - DNA, 23 bp, synthetic construct
  source 1..23: mol_type = other DNA
cccaccggatgagacctytctct

SEQ ID NO: 1565 - DNA, 23 bp, synthetic construct
  source 1..23: mol_type = other DNA
ccaccggatgagacctytctctt

SEQ ID NO: 1566 - DNA, 23 bp, synthetic construct
  source 1..23: mol_type = other DNA
ggtgaragctccgactttgacgg

SEQ ID NO: 1567 - DNA, 23 bp, synthetic construct
  source 1..23: mol_type = other DNA
gaccrgccacaagggctacgtgg

SEQ ID NO: 1568 - DNA, 23 bp, synthetic construct
  source 1..23: mol_type = other DNA
cccrgcctcccgggtccccaggg

SEQ ID NO: 1569 - DNA, 23 bp, synthetic construct
  source 1..23: mol_type = other DNA
gcccrgcctcccgggtccccagg

SEQ ID NO: 1570 - DNA, 23 bp, synthetic construct
  source 1..23: mol_type = other DNA
cccttcagtgttgtaygacgatg

SEQ ID NO: 1571 - DNA, 23 bp, synthetic construct
  source 1..23: mol_type = other DNA
ccttcagtgttgtaygacgatgt

SEQ ID NO: 1572 - DNA, 23 bp, synthetic construct
  source 1..23: mol_type = other DNA
ccatggagaagaccaaayaggag

SEQ ID NO: 1573 - DNA, 23 bp, synthetic construct
  source 1..23: mol_type = other DNA
ccggaagatccacgagyaggggc

SEQ ID NO: 1574 - DNA, 23 bp, synthetic construct
  source 1..23: mol_type = other DNA
ccagaaacagtagagyagctgag

SEQ ID NO: 1575 - DNA, 23 bp, synthetic construct
  source 1..23: mol_type = other DNA
ccttccgtatccatcgaagyaga

SEQ ID NO: 1576 - DNA, 23 bp, synthetic construct
  source 1..23: mol_type = other DNA
ccgtatccatcgaagyagatgct

SEQ ID NO: 1577 - DNA, 23 bp, synthetic construct
  source 1..23: mol_type = other DNA
tcatcgrggagccccaggactgg

SEQ ID NO: 1578 - DNA, 23 bp, synthetic construct
  source 1..23: mol_type = other DNA
gatcragtttctgtcgtggacgg

SEQ ID NO: 1579 - DNA, 23 bp, synthetic construct
  source 1..23: mol_type = other DNA
aggagatcragtttctgtcgtgg

SEQ ID NO: 1580 - DNA, 23 bp, synthetic construct
  source 1..23: mol_type = other DNA
caggaaarggatcattgaggggg

SEQ ID NO: 1581 - DNA, 23 bp, synthetic construct
  source 1..23: mol_type = other DNA
ccaggaaarggatcattgagggg

SEQ ID NO: 1582 - DNA, 23 bp, synthetic construct
  source 1..23: mol_type = other DNA
gtggtggragcaactggctcagg

SEQ ID NO: 1583 - DNA, 23 bp, synthetic construct
  source 1..23: mol_type = other DNA
ccaggtataatttcygtgggttt

SEQ ID NO: 1584 - DNA, 23 bp, synthetic construct
  source 1..23: mol_type = other DNA
ttctgccratgtgaaattaaagg

SEQ ID NO: 1585 - DNA, 23 bp, synthetic construct
  source 1..23: mol_type = other DNA
cttcraccaggcgcccgtggtgg

SEQ ID NO: 1586 - DNA, 23 bp, synthetic construct
  source 1..23: mol_type = other DNA
gggcttcraccaggcgcccgtgg

SEQ ID NO: 1587 - DNA, 23 bp, synthetic construct
  source 1..23: mol_type = other DNA
cctttatctttccaggaacycga

SEQ ID NO: 1588 - DNA, 23 bp, synthetic construct
  source 1..23: mol_type = other DNA
cctcggcccagacgcttaygaag

SEQ ID NO: 1589 - DNA, 23 bp, synthetic construct
  source 1..23: mol_type = other DNA
ccctcctgccctgcgcytcacag

SEQ ID NO: 1590 - DNA, 23 bp, synthetic construct
  source 1..23: mol_type = other DNA
cctcctgccctgcgcytcacaga

SEQ ID NO: 1591 - DNA, 23 bp, synthetic construct
  source 1..23: mol_type = other DNA
ccgcgtgcgggacgagtahcccc

SEQ ID NO: 1592 - DNA, 23 bp, synthetic construct
  source 1..23: mol_type = other DNA
ccaccaaatacttcaacyagctc

SEQ ID NO: 1593 - DNA, 23 bp, synthetic construct
  source 1..23: mol_type = other DNA
ccaaatacttcaacyagctcatc

SEQ ID NO: 1594 - DNA, 23 bp, synthetic construct
  source 1..23: mol_type = other DNA
gtccagccrcatcctgaagctgg

SEQ ID NO: 1595 - DNA, 23 bp, synthetic construct
  source 1..23: mol_type = other DNA
ccatrtgagtgatccggacacgg

SEQ ID NO: 1596 - DNA, 23 bp, synthetic construct
  source 1..23: mol_type = other DNA
ccgggacacttgactyaggagca

SEQ ID NO: 1597 - DNA, 23 bp, synthetic construct
  source 1..23: mol_type = other DNA
ccatcaagaacccccgctygact

SEQ ID NO: 1598 - DNA, 23 bp, synthetic construct
  source 1..23: mol_type = other DNA
ccagcagggccagaacyagctct

SEQ ID NO: 1599 - DNA, 23 bp, synthetic construct
  source 1..23: mol_type = other DNA
tacrtgcttcctgaaccctttgg

SEQ ID NO: 1600 - DNA, 23 bp, synthetic construct
  source 1..23: mol_type = other DNA
ccatggcactggcttcaygtcct

SEQ ID NO: 1601 - DNA, 23 bp, synthetic construct
  source 1..23: mol_type = other DNA
caagrtgcgcgaggccggtgggg

SEQ ID NO: 1602 - DNA, 23 bp, synthetic construct
  source 1..23: mol_type = other DNA
tcaagrtgcgcgaggccggtggg

SEQ ID NO: 1603 - DNA, 23 bp, synthetic construct
  source 1..23: mol_type = other DNA
ttcaagrtgcgcgaggccggtgg

SEQ ID NO: 1604 - DNA, 23 bp, synthetic construct
  source 1..23: mol_type = other DNA
cgagrgctactatttctgctcgg

SEQ ID NO: 1605 - DNA, 23 bp, synthetic construct
  source 1..23: mol_type = other DNA
cccttgttctgttttyggacctg

SEQ ID NO: 1606 - DNA, 23 bp, synthetic construct
  source 1..23: mol_type = other DNA
ccttgttctgttttyggacctgc

SEQ ID NO: 1607 - DNA, 23 bp, synthetic construct
  source 1..23: mol_type = other DNA
ccctcccaggtccctcyggtcct

SEQ ID NO: 1608 - DNA, 23 bp, synthetic construct
  source 1..23: mol_type = other DNA
cctcccaggtccctcyggtcctg

SEQ ID NO: 1609 - DNA, 23 bp, synthetic construct
  source 1..23: mol_type = other DNA
cccttgctggaatattacyggga

SEQ ID NO: 1610 - DNA, 23 bp, synthetic construct
  source 1..23: mol_type = other DNA
ccttgctggaatattacygggac

SEQ ID NO: 1611 - DNA, 23 bp, synthetic construct
  source 1..23: mol_type = other DNA
ccttggccgtggggccaygggac

SEQ ID NO: 1612 - DNA, 23 bp, synthetic construct
  source 1..23: mol_type = other DNA
gtttrggggtaagtccggcatgg

SEQ ID NO: 1613 - DNA, 23 bp, synthetic construct
  source 1..23: mol_type = other DNA
gtttggggrtaagtccggcatgg

SEQ ID NO: 1614 - DNA, 23 bp, synthetic construct
  source 1..23: mol_type = other DNA
ttaractgaaaatattcctgtgg

SEQ ID NO: 1615 - DNA, 23 bp, synthetic construct
  source 1..23: mol_type = other DNA
ctcttgrctctgccaggagccgg

SEQ ID NO: 1616 - DNA, 23 bp, synthetic construct
  source 1..23: mol_type = other DNA
ctcttrgctctgccaggagccgg

SEQ ID NO: 1617 - DNA, 23 bp, synthetic construct
  source 1..23: mol_type = other DNA
cccccataccagaacctygaact

SEQ ID NO: 1618 - DNA, 23 bp, synthetic construct
  source 1..23: mol_type = other DNA
ccccataccagaacctygaacta

SEQ ID NO: 1619 - DNA, 23 bp, synthetic construct
  source 1..23: mol_type = other DNA
cccataccagaacctygaactat

SEQ ID NO: 1620 - DNA, 23 bp, synthetic construct
  source 1..23: mol_type = other DNA
ccataccagaacctygaactata

SEQ ID NO: 1621 - DNA, 23 bp, synthetic construct
  source 1..23: mol_type = other DNA
ccaactggaccattyagtacaac

SEQ ID NO: 1622 - DNA, 23 bp, synthetic construct
  source 1..23: mol_type = other DNA
ccgagaaccacaagygtctcccc

SEQ ID NO: 1623 - DNA, 23 bp, synthetic construct
  source 1..23: mol_type = other DNA
ctgrggcaccaccatgctcctgg

SEQ ID NO: 1624 - DNA, 23 bp, synthetic construct
  source 1..23: mol_type = other DNA
gcggcaccrggtgccaggtgtgg

SEQ ID NO: 1625 - DNA, 23 bp, synthetic construct
  source 1..23: mol_type = other DNA
gtgarcagtgatggagggcctgg

SEQ ID NO: 1626 - DNA, 23 bp, synthetic construct
  source 1..23: mol_type = other DNA
cccatcttcatcaacctgcytta

SEQ ID NO: 1627 - DNA, 23 bp, synthetic construct
  source 1..23: mol_type = other DNA
ccatcttcatcaacctgcyttac

SEQ ID NO: 1628 - DNA, 23 bp, synthetic construct
  source 1..23: mol_type = other DNA
ccttttgagccacgcacccyggt

SEQ ID NO: 1629 - DNA, 23 bp, synthetic construct
  source 1..23: mol_type = other DNA
cctgctcaaacagatcagcyagg

SEQ ID NO: 1630 - DNA, 23 bp, synthetic construct
  source 1..23: mol_type = other DNA
tccgtgracatgtggtcggtggg

SEQ ID NO: 1631 - DNA, 23 bp, synthetic construct
  source 1..23: mol_type = other DNA
gtccgtgracatgtggtcggtgg

SEQ ID NO: 1632 - DNA, 23 bp, synthetic construct
  source 1..23: mol_type = other DNA
tacagargtaagcccacccccgg

SEQ ID NO: 1633 - DNA, 23 bp, synthetic construct
  source 1..23: mol_type = other DNA
cctttctttcagagcyagccatt

SEQ ID NO: 1634 - DNA, 23 bp, synthetic construct
  source 1..23: mol_type = other DNA
ccagatggtatcggtcccyagaa

SEQ ID NO: 1635 - DNA, 23 bp, synthetic construct
  source 1..23: mol_type = other DNA
ccagctgacagatacttgayaga

SEQ ID NO: 1636 - DNA, 23 bp, synthetic construct
  source 1..23: mol_type = other DNA
ccacttccatctgagyagatgaa

SEQ ID NO: 1637 - DNA, 23 bp, synthetic construct
  source 1..23: mol_type = other DNA
ccagcccttaacagctcaayaaa

SEQ ID NO: 1638 - DNA, 23 bp, synthetic construct
  source 1..23: mol_type = other DNA
cccttaacagctcaayaaaccaa

SEQ ID NO: 1639 - DNA, 23 bp, synthetic construct
  source 1..23: mol_type = other DNA
ccttaacagctcaayaaaccaaa

SEQ ID NO: 1640 - DNA, 23 bp, synthetic construct
  source 1..23: mol_type = other DNA
cccttctggaagaaataacygaa

SEQ ID NO: 1641 - DNA, 23 bp, synthetic construct
  source 1..23: mol_type = other DNA
ccttctggaagaaataacygaaa

SEQ ID NO: 1642 - DNA, 23 bp, synthetic construct
  source 1..23: mol_type = other DNA
ccctgatcttctgacgttgyaga

SEQ ID NO: 1643 - DNA, 23 bp, synthetic construct
  source 1..23: mol_type = other DNA
cctgatcttctgacgttgyagaa

SEQ ID NO: 1644 - DNA, 23 bp, synthetic construct
  source 1..23: mol_type = other DNA
ccagcccttaacagctyaacaaa

SEQ ID NO: 1645 - DNA, 23 bp, synthetic construct
  source 1..23: mol_type = other DNA
gagtrgcaagaggtggagaaggg

SEQ ID NO: 1646 - DNA, 23 bp, synthetic construct
  source 1..23: mol_type = other DNA
cgagtrgcaagaggtggagaagg

SEQ ID NO: 1647 - DNA, 23 bp, synthetic construct
  source 1..23: mol_type = other DNA
gatctccrgtgagccccgcacgg

SEQ ID NO: 1648 - DNA, 23 bp, synthetic construct
  source 1..23: mol_type = other DNA
caccgrcccgcaggagactgcgg

SEQ ID NO: 1649 - DNA, 23 bp, synthetic construct
  source 1..23: mol_type = other DNA
ccccacccatggtaggygatcca

SEQ ID NO: 1650 - DNA, 23 bp, synthetic construct
  source 1..23: mol_type = other DNA
cccacccatggtaggygatccac

SEQ ID NO: 1651 - DNA, 23 bp, synthetic construct
  source 1..23: mol_type = other DNA
ccacccatggtaggygatccaca

SEQ ID NO: 1652 - DNA, 23 bp, synthetic construct
  source 1..23: mol_type = other DNA
ccatgtgacgaacactatyggag

SEQ ID NO: 1653 - DNA, 23 bp, synthetic construct
  source 1..23: mol_type = other DNA
cctgcagctgtccctcyagaggt

SEQ ID NO: 1654 - DNA, 23 bp, synthetic construct
  source 1..23: mol_type = other DNA
ggagcrggggtttgagtggctgg

SEQ ID NO: 1655 - DNA, 23 bp, synthetic construct
  source 1..23: mol_type = other DNA
tgcgtcrgattctttctagatgg

SEQ ID NO: 1656 - DNA, 23 bp, synthetic construct
  source 1..23: mol_type = other DNA
cctggcacccaggggaayaacag

SEQ ID NO: 1657 - DNA, 23 bp, synthetic construct
  source 1..23: mol_type = other DNA
cccggcccacttcaccggcygct

SEQ ID NO: 1658 - DNA, 23 bp, synthetic construct
  source 1..23: mol_type = other DNA
ccggcccacttcaccggcygcta

SEQ ID NO: 1659 - DNA, 23 bp, synthetic construct
  source 1..23: mol_type = other DNA
cccacttcaccggcygctactgc

SEQ ID NO: 1660 - DNA, 23 bp, synthetic construct
  source 1..23: mol_type = other DNA
tacaaatrttttgaaggttttgg

SEQ ID NO: 1661 - DNA, 23 bp, synthetic construct
  source 1..23: mol_type = other DNA
tgtgatgrtatcaatgattgtgg

SEQ ID NO: 1662 - DNA, 23 bp, synthetic construct
  source 1..23: mol_type = other DNA
cccggacccgcaggygagcctgt

SEQ ID NO: 1663 - DNA, 23 bp, synthetic construct
  source 1..23: mol_type = other DNA
atactgctrggaagaagcaatgg

SEQ ID NO: 1664 - DNA, 23 bp, synthetic construct
  source 1..23: mol_type = other DNA
ggtcactcrgcaatttccctggg

SEQ ID NO: 1665 - DNA, 23 bp, synthetic construct
  source 1..23: mol_type = other DNA
aatatrgaaagttgcagatgagg

SEQ ID NO: 1666 - DNA, 23 bp, synthetic construct
  source 1..23: mol_type = other DNA
tttccaracttcacttctaatgg

SEQ ID NO: 1667 - DNA, 23 bp, synthetic construct
  source 1..23: mol_type = other DNA
accttatargtgggcctcttggg

SEQ ID NO: 1668 - DNA, 23 bp, synthetic construct
  source 1..23: mol_type = other DNA
cagaraatgggatagagagctgg

SEQ ID NO: 1669 - DNA, 23 bp, synthetic construct
  source 1..23: mol_type = other DNA
cagagaatrggatagagagctgg

SEQ ID NO: 1670 - DNA, 23 bp, synthetic construct
  source 1..23: mol_type = other DNA
cctccggaaaatattcaycacca

SEQ ID NO: 1671 - DNA, 23 bp, synthetic construct
  source 1..23: mol_type = other DNA
ccggaaaatattcaycaccatct

SEQ ID NO: 1672 - DNA, 23 bp, synthetic construct
  source 1..23: mol_type = other DNA
ccaatcaactctataygaaaatt

SEQ ID NO: 1673 - DNA, 23 bp, synthetic construct
  source 1..23: mol_type = other DNA
ccagggacttgcattggcayatt

SEQ ID NO: 1674 - DNA, 23 bp, synthetic construct
  source 1..23: mol_type = other DNA
ccccacgcttcaggcaygaagga

SEQ ID NO: 1675 - DNA, 23 bp, synthetic construct
  source 1..23: mol_type = other DNA
cccacgcttcaggcaygaaggag

SEQ ID NO: 1676 - DNA, 23 bp, synthetic construct
  source 1..23: mol_type = other DNA
ccacgcttcaggcaygaaggagg

SEQ ID NO: 1677 - DNA, 23 bp, synthetic construct
  source 1..23: mol_type = other DNA
ccaaggtcagaacattcacygaa

SEQ ID NO: 1678 - DNA, 23 bp, synthetic construct
  source 1..23: mol_type = other DNA
tgcraacactccccattcgatgg

SEQ ID NO: 1679 - DNA, 23 bp, synthetic construct
  source 1..23: mol_type = other DNA
tccatccrccgattccaggaggg

SEQ ID NO: 1680 - DNA, 23 bp, synthetic construct
  source 1..23: mol_type = other DNA
gtccatccrccgattccaggagg

SEQ ID NO: 1681 - DNA, 23 bp, synthetic construct
  source 1..23: mol_type = other DNA
cccgtgcccccgctgyagcagac

SEQ ID NO: 1682 - DNA, 23 bp, synthetic construct
  source 1..23: mol_type = other DNA
ccgtgcccccgctgyagcagacc

SEQ ID NO: 1683 - DNA, 23 bp, synthetic construct
  source 1..23: mol_type = other DNA
ccacttagcctcctyggcagaaa

SEQ ID NO: 1684 - DNA, 23 bp, synthetic construct
  source 1..23: mol_type = other DNA
ccctgaagcagagaccaygattt

SEQ ID NO: 1685 - DNA, 23 bp, synthetic construct
  source 1..23: mol_type = other DNA
cctgaagcagagaccaygatttg

SEQ ID NO: 1686 - DNA, 23 bp, synthetic construct
  source 1..23: mol_type = other DNA
taaactrgctacttttcaattgg

SEQ ID NO: 1687 - DNA, 23 bp, synthetic construct
  source 1..23: mol_type = other DNA
taaacacrgggtcagtcggacgg

SEQ ID NO: 1688 - DNA, 23 bp, synthetic construct
  source 1..23: mol_type = other DNA
cccacaagcaatccaggaaygac

SEQ ID NO: 1689 - DNA, 23 bp, synthetic construct
  source 1..23: mol_type = other DNA
ccacaagcaatccaggaaygact

SEQ ID NO: 1690 - DNA, 23 bp, synthetic construct
  source 1..23: mol_type = other DNA
ccccagaaacatgcagyagtctc

SEQ ID NO: 1691 - DNA, 23 bp, synthetic construct
  source 1..23: mol_type = other DNA
cccagaaacatgcagyagtctcg

SEQ ID NO: 1692 - DNA, 23 bp, synthetic construct
  source 1..23: mol_type = other DNA
ccagaaacatgcagyagtctcgt

SEQ ID NO: 1693 - DNA, 23 bp, synthetic construct
  source 1..23: mol_type = other DNA
cctggataaagctgtgctayagt

SEQ ID NO: 1694 - DNA, 23 bp, synthetic construct
  source 1..23: mol_type = other DNA
cctgttgtcaataaaygaaatgg

SEQ ID NO: 1695 - DNA, 23 bp, synthetic construct
  source 1..23: mol_type = other DNA
tgccccctrggctcgattatggg

SEQ ID NO: 1696 - DNA, 23 bp, synthetic construct
  source 1..23: mol_type = other DNA
cccctgccccctgggctygatta

SEQ ID NO: 1697 - DNA, 23 bp, synthetic construct
  source 1..23: mol_type = other DNA
ccctgccccctgggctygattat

SEQ ID NO: 1698 - DNA, 23 bp, synthetic construct
  source 1..23: mol_type = other DNA
cctgccccctgggctygattatg

SEQ ID NO: 1699 - DNA, 23 bp, synthetic construct
  source 1..23: mol_type = other DNA
cctgaggaccaagaacytgagga

SEQ ID NO: 1700 - DNA, 23 bp, synthetic construct
  source 1..23: mol_type = other DNA
ccaggatattgtgaatyaagttc

SEQ ID NO: 1701 - DNA, 23 bp, synthetic construct
  source 1..23: mol_type = other DNA
atgtggrgtctcattgctcaggg

SEQ ID NO: 1702 - DNA, 23 bp, synthetic construct
  source 1..23: mol_type = other DNA
tatgtggrgtctcattgctcagg

SEQ ID NO: 1703 - DNA, 23 bp, synthetic construct
  source 1..23: mol_type = other DNA
cctaattraagatgtcaagatgg

SEQ ID NO: 1704 - DNA, 23 bp, synthetic construct
  source 1..23: mol_type = other DNA
ccaagatgacgataaaccyaatt

SEQ ID NO: 1705 - DNA, 23 bp, synthetic construct
  source 1..23: mol_type = other DNA
cctgctgctcatcaycgagatca

SEQ ID NO: 1706 - DNA, 23 bp, synthetic construct
  source 1..23: mol_type = other DNA
tactrtgttcctgctgctgctgg

SEQ ID NO: 1707 - DNA, 23 bp, synthetic construct
  source 1..23: mol_type = other DNA
cctgcggcccgcggaaygagact

SEQ ID NO: 1708 - DNA, 23 bp, synthetic construct
  source 1..23: mol_type = other DNA
ccatgcatgggggcyaggggccg

SEQ ID NO: 1709 - DNA, 23 bp, synthetic construct
  source 1..23: mol_type = other DNA
gctacraggacgtggcacgcggg

SEQ ID NO: 1710 - DNA, 23 bp, synthetic construct
  source 1..23: mol_type = other DNA
cgctacraggacgtggcacgcgg

SEQ ID NO: 1711 - DNA, 23 bp, synthetic construct
  source 1..23: mol_type = other DNA
cgtggrgaaagaggtaggcctgg

SEQ ID NO: 1712 - DNA, 23 bp, synthetic construct
  source 1..23: mol_type = other DNA
tgtttcragtgctggcagtgtgg

SEQ ID NO: 1713 - DNA, 23 bp, synthetic construct
  source 1..23: mol_type = other DNA
ccagttctggatgtycatcgtgg

SEQ ID NO: 1714 - DNA, 23 bp, synthetic construct
  source 1..23: mol_type = other DNA
ccccagagacccctgtgcyatct

SEQ ID NO: 1715 - DNA, 23 bp, synthetic construct
  source 1..23: mol_type = other DNA
cccagagacccctgtgcyatctc

SEQ ID NO: 1716 - DNA, 23 bp, synthetic construct
  source 1..23: mol_type = other DNA
ccagagacccctgtgcyatctcc

SEQ ID NO: 1717 - DNA, 23 bp, synthetic construct
  source 1..23: mol_type = other DNA
ccaccactatgcccatacyctgc

SEQ ID NO: 1718 - DNA, 23 bp, synthetic construct
  source 1..23: mol_type = other DNA
ccactatgcccatacyctgcgga

SEQ ID NO: 1719 - DNA, 23 bp, synthetic construct
  source 1..23: mol_type = other DNA
ccgtactggtggcggcccyagcc

SEQ ID NO: 1720 - DNA, 23 bp, synthetic construct
  source 1..23: mol_type = other DNA
gttgrggctgcagcctgcttagg

SEQ ID NO: 1721 - DNA, 23 bp, synthetic construct
  source 1..23: mol_type = other DNA
tgttccrggccctgggcctgcgg

SEQ ID NO: 1722 - DNA, 23 bp, synthetic construct
  source 1..23: mol_type = other DNA
cctgatgggagctgctgccyagc

SEQ ID NO: 1723 - DNA, 23 bp, synthetic construct
  source 1..23: mol_type = other DNA
ccgggccctgggcctgyggcacc

SEQ ID NO: 1724 - DNA, 23 bp, synthetic construct
  source 1..23: mol_type = other DNA
ggcarcggcggcagtgggcgtgg

SEQ ID NO: 1725 - DNA, 23 bp, synthetic construct
  source 1..23: mol_type = other DNA
ctgrgctcctggacaccaggtgg

SEQ ID NO: 1726 - DNA, 23 bp, synthetic construct
  source 1..23: mol_type = other DNA
ttcctgrgctcctggacaccagg

SEQ ID NO: 1727 - DNA, 23 bp, synthetic construct
  source 1..23: mol_type = other DNA
ccaaggttctggaatccyggagg

SEQ ID NO: 1728 - DNA, 23 bp, synthetic construct
  source 1..23: mol_type = other DNA
ctcrgaatggctgggtctctggg

SEQ ID NO: 1729 - DNA, 23 bp, synthetic construct
  source 1..23: mol_type = other DNA
gctcrgaatggctgggtctctgg

SEQ ID NO: 1730 - DNA, 23 bp, synthetic construct
  source 1..23: mol_type = other DNA
tcagrtaccccaggaatcattgg

SEQ ID NO: 1731 - DNA, 23 bp, synthetic construct
  source 1..23: mol_type = other DNA
tttgrttggtcctgttggctcgg

SEQ ID NO: 1732 - DNA, 23 bp, synthetic construct
  source 1..23: mol_type = other DNA
ccctgagtcacgctyagcaatac

SEQ ID NO: 1733 - DNA, 23 bp, synthetic construct
  source 1..23: mol_type = other DNA
catggrtgccagcatccacctgg

SEQ ID NO: 1734 - DNA, 23 bp, synthetic construct
  source 1..23: mol_type = other DNA
ctgrtgagtggacatcagcatgg

SEQ ID NO: 1735 - DNA, 23 bp, synthetic construct
  source 1..23: mol_type = other DNA
cccttccacctcgacytctggtt

SEQ ID NO: 1736 - DNA, 23 bp, synthetic construct
  source 1..23: mol_type = other DNA
ccttccacctcgacytctggttc

SEQ ID NO: 1737 - DNA, 23 bp, synthetic construct
  source 1..23: mol_type = other DNA
acatcaagrggagcaagtcgggg

SEQ ID NO: 1738 - DNA, 23 bp, synthetic construct
  source 1..23: mol_type = other DNA
ggccrtggtggctgatgatgggg

SEQ ID NO: 1739 - DNA, 23 bp, synthetic construct
  source 1..23: mol_type = other DNA
tggccrtggtggctgatgatggg

SEQ ID NO: 1740 - DNA, 23 bp, synthetic construct
  source 1..23: mol_type = other DNA
ctggccrtggtggctgatgatgg

SEQ ID NO: 1741 - DNA, 23 bp, synthetic construct
  source 1..23: mol_type = other DNA
ccgcctactgaagttttccyggc

SEQ ID NO: 1742 - DNA, 23 bp, synthetic construct
  source 1..23: mol_type = other DNA
cctactgaagttttccyggctct

SEQ ID NO: 1743 - DNA, 23 bp, synthetic construct
  source 1..23: mol_type = other DNA
cccagaagtgaggttcaacygcc

SEQ ID NO: 1744 - DNA, 23 bp, synthetic construct
  source 1..23: mol_type = other DNA
ccagaagtgaggttcaacygcct

SEQ ID NO: 1745 - DNA, 23 bp, synthetic construct
  source 1..23: mol_type = other DNA
ccaaggacttggagacgygggtt

SEQ ID NO: 1746 - DNA, 23 bp, synthetic construct
  source 1..23: mol_type = other DNA
tcctrgtgggcatcctcccaggg

SEQ ID NO: 1747 - DNA, 23 bp, synthetic construct
  source 1..23: mol_type = other DNA
atcctrgtgggcatcctcccagg

SEQ ID NO: 1748 - DNA, 23 bp, synthetic construct
  source 1..23: mol_type = other DNA
ccttcaccragcacgagcggcgg

SEQ ID NO: 1749 - DNA, 23 bp, synthetic construct
  source 1..23: mol_type = other DNA
cttcggaragatcgtgccccagg

SEQ ID NO: 1750 - DNA, 23 bp, synthetic construct
  source 1..23: mol_type = other DNA
cctcctacagaggtctctyagtt

SEQ ID NO: 1751 - DNA, 23 bp, synthetic construct
  source 1..23: mol_type = other DNA
cctacagaggtctctyagtttag

SEQ ID NO: 1752 - DNA, 23 bp, synthetic construct
  source 1..23: mol_type = other DNA
tactrgggaggctctgggcctgg

SEQ ID NO: 1753 - DNA, 23 bp, synthetic construct
  source 1..23: mol_type = other DNA
ccccagtccagccccgtgyaggc

SEQ ID NO: 1754 - DNA, 23 bp, synthetic construct
  source 1..23: mol_type = other DNA
cccagtccagccccgtgyaggcc

SEQ ID NO: 1755 - DNA, 23 bp, synthetic construct
  source 1..23: mol_type = other DNA
ccagtccagccccgtgyaggcca

SEQ ID NO: 1756 - DNA, 23 bp, synthetic construct
  source 1..23: mol_type = other DNA
ccgagacaagtttgccyggctct

SEQ ID NO: 1757 - DNA, 23 bp, synthetic construct
  source 1..23: mol_type = other DNA
ccctgrgcagaagggtgagatgg

SEQ ID NO: 1758 - DNA, 23 bp, synthetic construct
  source 1..23: mol_type = other DNA
cccattggtccgccagggygccc

SEQ ID NO: 1759 - DNA, 23 bp, synthetic construct
  source 1..23: mol_type = other DNA
ccattggtccgccagggygccca

SEQ ID NO: 1760 - DNA, 23 bp, synthetic construct
  source 1..23: mol_type = other DNA
cctggttccgaggggygacaagg

SEQ ID NO: 1761 - DNA, 23 bp, synthetic construct
  source 1..23: mol_type = other DNA
acaacgcratattgcagcacagg

SEQ ID NO: 1762 - DNA, 23 bp, synthetic construct
  source 1..23: mol_type = other DNA
ccagrcccccagggtcctccagg

SEQ ID NO: 1763 - DNA, 23 bp, synthetic construct
  source 1..23: mol_type = other DNA
cgtgrtgaggcagggcctcctgg

SEQ ID NO: 1764 - DNA, 23 bp, synthetic construct
  source 1..23: mol_type = other DNA
cctggtcccccagggcctygagg

SEQ ID NO: 1765 - DNA, 23 bp, synthetic construct
  source 1..23: mol_type = other DNA
gccaatrtaagtatcctgccagg

SEQ ID NO: 1766 - DNA, 23 bp, synthetic construct
  source 1..23: mol_type = other DNA
agctgrtctgcctggtgccaagg

SEQ ID NO: 1767 - DNA, 23 bp, synthetic construct
  source 1..23: mol_type = other DNA
cccgrtagccagggcgcccctgg

SEQ ID NO: 1768 - DNA, 23 bp, synthetic construct
  source 1..23: mol_type = other DNA
gctgrtcttccagggcctaaggg

SEQ ID NO: 1769 - DNA, 23 bp, synthetic construct
  source 1..23: mol_type = other DNA
agctgrtcttccagggcctaagg

SEQ ID NO: 1770 - DNA, 23 bp, synthetic construct
  source 1..23: mol_type = other DNA
gctrgtccccctggccctgccgg

SEQ ID NO: 1771 - DNA, 23 bp, synthetic construct
  source 1..23: mol_type = other DNA
gccrgacccgctggaccccctgg

SEQ ID NO: 1772 - DNA, 23 bp, synthetic construct
  source 1..23: mol_type = other DNA
ccccctgrccccattgtgagtgg

SEQ ID NO: 1773 - DNA, 23 bp, synthetic construct
  source 1..23: mol_type = other DNA
ccctrgtgaatctggacgtgagg

SEQ ID NO: 1774 - DNA, 23 bp, synthetic construct
  source 1..23: mol_type = other DNA
cctrgacgagacggttctcctgg

SEQ ID NO: 1775 - DNA, 23 bp, synthetic construct
  source 1..23: mol_type = other DNA
accrgccccgctggaccccctgg

SEQ ID NO: 1776 - DNA, 23 bp, synthetic construct
  source 1..23: mol_type = other DNA
gctgrcaagagtggtgatcgtgg

SEQ ID NO: 1777 - DNA, 23 bp, synthetic construct
  source 1..23: mol_type = other DNA
gtcrgccctgttggcgcccgtgg

SEQ ID NO: 1778 - DNA, 23 bp, synthetic construct
  source 1..23: mol_type = other DNA
caargcccccgtggtgacaaggg

SEQ ID NO: 1779 - DNA, 23 bp, synthetic construct
  source 1..23: mol_type = other DNA
ccaargcccccgtggtgacaagg

SEQ ID NO: 1780 - DNA, 23 bp, synthetic construct
  source 1..23: mol_type = other DNA
cccrgccctcctggacctcctgg

SEQ ID NO: 1781 - DNA, 23 bp, synthetic construct
  source 1..23: mol_type = other DNA
gaargttcccctggacgagacgg

SEQ ID NO: 1782 - DNA, 23 bp, synthetic construct
  source 1..23: mol_type = other DNA
cgagrattgcccggaacagctgg

SEQ ID NO: 1783 - DNA, 23 bp, synthetic construct
  source 1..23: mol_type = other DNA
gatgrtgccaagggagatgctgg

SEQ ID NO: 1784 - DNA, 23 bp, synthetic construct
  source 1..23: mol_type = other DNA
tgccrggccccctgtgagtgtgg

SEQ ID NO: 1785 - DNA, 23 bp, synthetic construct
  source 1..23: mol_type = other DNA
ccccctggtgaatctggaygtga

SEQ ID NO: 1786 - DNA, 23 bp, synthetic construct
  source 1..23: mol_type = other DNA
cccctggtgaatctggaygtgag

SEQ ID NO: 1787 - DNA, 23 bp, synthetic construct
  source 1..23: mol_type = other DNA
ccctggtgaatctggaygtgagg

SEQ ID NO: 1788 - DNA, 23 bp, synthetic construct
  source 1..23: mol_type = other DNA
cctggtgaatctggaygtgaggt

SEQ ID NO: 1789 - DNA, 23 bp, synthetic construct
  source 1..23: mol_type = other DNA
ccgaaggttcccctggaygagac

SEQ ID NO: 1790 - DNA, 23 bp, synthetic construct
  source 1..23: mol_type = other DNA
cctgcctggtgagagaggtygcc

SEQ ID NO: 1791 - DNA, 23 bp, synthetic construct
  source 1..23: mol_type = other DNA
cctggtgagagaggtygccctgg

SEQ ID NO: 1792 - DNA, 23 bp, synthetic construct
  source 1..23: mol_type = other DNA
cctrgtctcagaggtgaaattgg

SEQ ID NO: 1793 - DNA, 23 bp, synthetic construct
  source 1..23: mol_type = other DNA
gctgrtcctgctggtcctgctgg

SEQ ID NO: 1794 - DNA, 23 bp, synthetic construct
  source 1..23: mol_type = other DNA
aacrgtgttgttggtcccacagg

SEQ ID NO: 1795 - DNA, 23 bp, synthetic construct
  source 1..23: mol_type = other DNA
cctrgcactccaggtcctcaggg

SEQ ID NO: 1796 - DNA, 23 bp, synthetic construct
  source 1..23: mol_type = other DNA
tcctrgcactccaggtcctcagg

SEQ ID NO: 1797 - DNA, 23 bp, synthetic construct
  source 1..23: mol_type = other DNA
cctrgacctccaggtgtaagcgg

SEQ ID NO: 1798 - DNA, 23 bp, synthetic construct
  source 1..23: mol_type = other DNA
cgtgrtcctcctggtgctgtggg

SEQ ID NO: 1799 - DNA, 23 bp, synthetic construct
  source 1..23: mol_type = other DNA
ccgtgrtcctcctggtgctgtgg

SEQ ID NO: 1800 - DNA, 23 bp, synthetic construct
  source 1..23: mol_type = other DNA
caggrtccccctggtcctccagg

SEQ ID NO: 1801 - DNA, 23 bp, synthetic construct
  source 1..23: mol_type = other DNA
cagrgtcttcttggtgctcctgg

SEQ ID NO: 1802 - DNA, 23 bp, synthetic construct
  source 1..23: mol_type = other DNA
tctgrccctcctggtccccctgg

SEQ ID NO: 1803 - DNA, 23 bp, synthetic construct
  source 1..23: mol_type = other DNA
tttgrtctccctggtcctgctgg

SEQ ID NO: 1804 - DNA, 23 bp, synthetic construct
  source 1..23: mol_type = other DNA
tagrgtgatcctggcaaaaacgg

SEQ ID NO: 1805 - DNA, 23 bp, synthetic construct
  source 1..23: mol_type = other DNA
cctgrtagtcgtggtgcaagtgg

SEQ ID NO: 1806 - DNA, 23 bp, synthetic construct
  source 1..23: mol_type = other DNA
caggrcccccctggtccccctgg

SEQ ID NO: 1807 - DNA, 23 bp, synthetic construct
  source 1..23: mol_type = other DNA
gccrgtccccgtggtgaagtggg

SEQ ID NO: 1808 - DNA, 23 bp, synthetic construct
  source 1..23: mol_type = other DNA
cgccrgtccccgtggtgaagtgg

SEQ ID NO: 1809 - DNA, 23 bp, synthetic construct
  source 1..23: mol_type = other DNA
cctrgctcccctggccccgctgg

SEQ ID NO: 1810 - DNA, 23 bp, synthetic construct
  source 1..23: mol_type = other DNA
aaargccctgagggagcccctgg

SEQ ID NO: 1811 - DNA, 23 bp, synthetic construct
  source 1..23: mol_type = other DNA
aagggrtccgcctggtcctcagg

SEQ ID NO: 1812 - DNA, 23 bp, synthetic construct
  source 1..23: mol_type = other DNA
ggcggrtgctcctggtgtgaagg

SEQ ID NO: 1813 - DNA, 23 bp, synthetic construct
  source 1..23: mol_type = other DNA
gaargtccaccaggtccccaggg

SEQ ID NO: 1814 - DNA, 23 bp, synthetic construct
  source 1..23: mol_type = other DNA
cgaargtccaccaggtccccagg

SEQ ID NO: 1815 - DNA, 23 bp, synthetic construct
  source 1..23: mol_type = other DNA
cgcgrtttcccaggtcaagatgg

SEQ ID NO: 1816 - DNA, 23 bp, synthetic construct
  source 1..23: mol_type = other DNA
gtcrgtccctctggcaaagatgg

SEQ ID NO: 1817 - DNA, 23 bp, synthetic construct
  source 1..23: mol_type = other DNA
gaacrgatctccgggcccaatgg

SEQ ID NO: 1818 - DNA, 23 bp, synthetic construct
  source 1..23: mol_type = other DNA
tgtgraagccggagccctgccgg

SEQ ID NO: 1819 - DNA, 23 bp, synthetic construct
  source 1..23: mol_type = other DNA
cttccrtggacagcaggcgtagg

SEQ ID NO: 1820 - DNA, 23 bp, synthetic construct
  source 1..23: mol_type = other DNA
ctgragtcaaggtgagtgtctgg

SEQ ID NO: 1821 - DNA, 23 bp, synthetic construct
  source 1..23: mol_type = other DNA
cagrgtccccgtggcctccccgg

SEQ ID NO: 1822 - DNA, 23 bp, synthetic construct
  source 1..23: mol_type = other DNA
ccagggcctccagggtcccygtg

SEQ ID NO: 1823 - DNA, 23 bp, synthetic construct
  source 1..23: mol_type = other DNA
ccctggagctgctggcygcgttg

SEQ ID NO: 1824 - DNA, 23 bp, synthetic construct
  source 1..23: mol_type = other DNA
cctggagctgctggcygcgttgg

SEQ ID NO: 1825 - DNA, 23 bp, synthetic construct
  source 1..23: mol_type = other DNA
gagracggccaggacttcctggg

SEQ ID NO: 1826 - DNA, 23 bp, synthetic construct
  source 1..23: mol_type = other DNA
cgagracggccaggacttcctgg

SEQ ID NO: 1827 - DNA, 23 bp, synthetic construct
  source 1..23: mol_type = other DNA
cccrgacttccaggtatagctgg

SEQ ID NO: 1828 - DNA, 23 bp, synthetic construct
  source 1..23: mol_type = other DNA
caggraaaccctggatcagatgg

SEQ ID NO: 1829 - DNA, 23 bp, synthetic construct
  source 1..23: mol_type = other DNA
agargggctcctggtgagcgagg

SEQ ID NO: 1830 - DNA, 23 bp, synthetic construct
  source 1..23: mol_type = other DNA
actrgccctccaggacctgctgg

SEQ ID NO: 1831 - DNA, 23 bp, synthetic construct
  source 1..23: mol_type = other DNA
gccgrtgcacctggagctccagg

SEQ ID NO: 1832 - DNA, 23 bp, synthetic construct
  source 1..23: mol_type = other DNA
cgtgragctgctggcatcaaagg

SEQ ID NO: 1833 - DNA, 23 bp, synthetic construct
  source 1..23: mol_type = other DNA
ccctrgatcccctggtgctaagg

SEQ ID NO: 1834 - DNA, 23 bp, synthetic construct
  source 1..23: mol_type = other DNA
gctgrccaaccaggagagaaggg

SEQ ID NO: 1835 - DNA, 23 bp, synthetic construct
  source 1..23: mol_type = other DNA
tgctgrccaaccaggagagaagg

SEQ ID NO: 1836 - DNA, 23 bp, synthetic construct
  source 1..23: mol_type = other DNA
actgragcacggggtcttgcagg

SEQ ID NO: 1837 - DNA, 23 bp, synthetic construct
  source 1..23: mol_type = other DNA
cctrggccacctggtgctgctgg

SEQ ID NO: 1838 - DNA, 23 bp, synthetic construct
  source 1..23: mol_type = other DNA
tagrgagctccaggcccacttgg

SEQ ID NO: 1839 - DNA, 23 bp, synthetic construct
  source 1..23: mol_type = other DNA
cgtrgagctgctggcatcaaagg

SEQ ID NO: 1840 - DNA, 23 bp, synthetic construct
  source 1..23: mol_type = other DNA
cctrgtacatctggtcatcctgg

SEQ ID NO: 1841 - DNA, 23 bp, synthetic construct
  source 1..23: mol_type = other DNA
cttrggattgctgggatcactgg

SEQ ID NO: 1842 - DNA, 23 bp, synthetic construct
  source 1..23: mol_type = other DNA
cgtgrtccccctggaccccaggg

SEQ ID NO: 1843 - DNA, 23 bp, synthetic construct
  source 1..23: mol_type = other DNA
acgtgrtccccctggaccccagg

SEQ ID NO: 1844 - DNA, 23 bp, synthetic construct
  source 1..23: mol_type = other DNA
cctgrtccccaaggtgtcaaagg

SEQ ID NO: 1845 - DNA, 23 bp, synthetic construct
  source 1..23: mol_type = other DNA
cagrtcccattggaccaccaggg

SEQ ID NO: 1846 - DNA, 23 bp, synthetic construct
  source 1..23: mol_type = other DNA
ccagrtcccattggaccaccagg

SEQ ID NO: 1847 - DNA, 23 bp, synthetic construct
  source 1..23: mol_type = other DNA
gcargggccccaggacttagagg

SEQ ID NO: 1848 - DNA, 23 bp, synthetic construct
  source 1..23: mol_type = other DNA
cctgrgttccgaggacctgctgg

SEQ ID NO: 1849 - DNA, 23 bp, synthetic construct
  source 1..23: mol_type = other DNA
gatgracgaaatggagaaaaggg

SEQ ID NO: 1850 - DNA, 23 bp, synthetic construct
  source 1..23: mol_type = other DNA
cgatgracgaaatggagaaaagg

SEQ ID NO: 1851 - DNA, 23 bp, synthetic construct
  source 1..23: mol_type = other DNA
cagargtgaaagaggatctgagg

SEQ ID NO: 1852 - DNA, 23 bp, synthetic construct
  source 1..23: mol_type = other DNA
cttrgaagtcctggtccaaaggg

SEQ ID NO: 1853 - DNA, 23 bp, synthetic construct
  source 1..23: mol_type = other DNA
tcttrgaagtcctggtccaaagg

SEQ ID NO: 1854 - DNA, 23 bp, synthetic construct
  source 1..23: mol_type = other DNA
caggrtccaaagggtgatgccgg

SEQ ID NO: 1855 - DNA, 23 bp, synthetic construct
  source 1..23: mol_type = other DNA
taggrtcctcctggtccccaagg

SEQ ID NO: 1856 - DNA, 23 bp, synthetic construct
  source 1..23: mol_type = other DNA
agtgracctcctggcaaagatgg

SEQ ID NO: 1857 - DNA, 23 bp, synthetic construct
  source 1..23: mol_type = other DNA
aatrgtgcccctggacaaagagg

SEQ ID NO: 1858 - DNA, 23 bp, synthetic construct
  source 1..23: mol_type = other DNA
ctgtaarttttgtcattttttgg

SEQ ID NO: 1859 - DNA, 23 bp, synthetic construct
  source 1..23: mol_type = other DNA
cctrgacctcctggtgcccctgg

SEQ ID NO: 1860 - DNA, 23 bp, synthetic construct
  source 1..23: mol_type = other DNA
gatgrgcccccaggtcctgcggg

SEQ ID NO: 1861 - DNA, 23 bp, synthetic construct
  source 1..23: mol_type = other DNA
ggatgrgcccccaggtcctgcgg

SEQ ID NO: 1862 - DNA, 23 bp, synthetic construct
  source 1..23: mol_type = other DNA
ccagrcatgccaggtcctagggg

SEQ ID NO: 1863 - DNA, 23 bp, synthetic construct
  source 1..23: mol_type = other DNA
accagrcatgccaggtcctaggg

SEQ ID NO: 1864 - DNA, 23 bp, synthetic construct
  source 1..23: mol_type = other DNA
caccagrcatgccaggtcctagg

SEQ ID NO: 1865 - DNA, 23 bp, synthetic construct
  source 1..23: mol_type = other DNA
aggragctccaggcccacttggg

SEQ ID NO: 1866 - DNA, 23 bp, synthetic construct
  source 1..23: mol_type = other DNA
taggragctccaggcccacttgg

SEQ ID NO: 1867 - DNA, 23 bp, synthetic construct
  source 1..23: mol_type = other DNA
ggagrccctcctggagttgcagg

SEQ ID NO: 1868 - DNA, 23 bp, synthetic construct
  source 1..23: mol_type = other DNA
atcrgcagtccaggacctgcagg

SEQ ID NO: 1869 - DNA, 23 bp, synthetic construct
  source 1..23: mol_type = other DNA
tgtaartatcatagttgagaggg

SEQ ID NO: 1870 - DNA, 23 bp, synthetic construct
  source 1..23: mol_type = other DNA
ctgtaartatcatagttgagagg

SEQ ID NO: 1871 - DNA, 23 bp, synthetic construct
  source 1..23: mol_type = other DNA
gtcgrtccagctggaaagagtgg

SEQ ID NO: 1872 - DNA, 23 bp, synthetic construct
  source 1..23: mol_type = other DNA
cctrgagaaagaggaggtcttgg

SEQ ID NO: 1873 - DNA, 23 bp, synthetic construct
  source 1..23: mol_type = other DNA
cctgrtcatccaggcccacctgg

SEQ ID NO: 1874 - DNA, 23 bp, synthetic construct
  source 1..23: mol_type = other DNA
cctgrtgctgctggtactcctgg

SEQ ID NO: 1875 - DNA, 23 bp, synthetic construct
  source 1..23: mol_type = other DNA
gctrgtgctcccggtcctgctgg

SEQ ID NO: 1876 - DNA, 23 bp, synthetic construct
  source 1..23: mol_type = other DNA
cagrgccctccaggacctcctgg

SEQ ID NO: 1877 - DNA, 23 bp, synthetic construct
  source 1..23: mol_type = other DNA
aaargacatcgaggattccctgg

SEQ ID NO: 1878 - DNA, 23 bp, synthetic construct
  source 1..23: mol_type = other DNA
ccargcccacttgggattgctgg

SEQ ID NO: 1879 - DNA, 23 bp, synthetic construct
  source 1..23: mol_type = other DNA
caggracacgctggtgctcaagg

SEQ ID NO: 1880 - DNA, 23 bp, synthetic construct
  source 1..23: mol_type = other DNA
cctgraccccagggtcttcctgg

SEQ ID NO: 1881 - DNA, 23 bp, synthetic construct
  source 1..23: mol_type = other DNA
aggrgaagccctggccctcaggg

SEQ ID NO: 1882 - DNA, 23 bp, synthetic construct
  source 1..23: mol_type = other DNA
taggrgaagccctggccctcagg

SEQ ID NO: 1883 - DNA, 23 bp, synthetic construct
  source 1..23: mol_type = other DNA
cctgrtctgcaaggaatgcctgg

SEQ ID NO: 1884 - DNA, 23 bp, synthetic construct
  source 1..23: mol_type = other DNA
aacrgtctcagtggagaacgtgg

SEQ ID NO: 1885 - DNA, 23 bp, synthetic construct
  source 1..23: mol_type = other DNA
cccrgaagtccaggaggaccagg

SEQ ID NO: 1886 - DNA, 23 bp, synthetic construct
  source 1..23: mol_type = other DNA
aatgrtgctcctggactgcgagg

SEQ ID NO: 1887 - DNA, 23 bp, synthetic construct
  source 1..23: mol_type = other DNA
agagrtggagctggtccccctgg

SEQ ID NO: 1888 - DNA, 23 bp, synthetic construct
  source 1..23: mol_type = other DNA
aacagrtgctcctggattaaagg

SEQ ID NO: 1889 - DNA, 23 bp, synthetic construct
  source 1..23: mol_type = other DNA
caggrtgaaagtgggaaaccagg

SEQ ID NO: 1890 - DNA, 23 bp, synthetic construct
  source 1..23: mol_type = other DNA
ccagracctcctggtgctatagg

SEQ ID NO: 1891 - DNA, 23 bp, synthetic construct
  source 1..23: mol_type = other DNA
ccagrcaaggatgggcccccagg

SEQ ID NO: 1892 - DNA, 23 bp, synthetic construct
  source 1..23: mol_type = other DNA
ccargataccaaggaccccctgg

SEQ ID NO: 1893 - DNA, 23 bp, synthetic construct
  source 1..23: mol_type = other DNA
agargaggtcttggaagtcctgg

SEQ ID NO: 1894 - DNA, 23 bp, synthetic construct
  source 1..23: mol_type = other DNA
aaagrtgaaacaggtgaacgtgg

SEQ ID NO: 1895 - DNA, 23 bp, synthetic construct
  source 1..23: mol_type = other DNA
acagraccccctggtccacaagg

SEQ ID NO: 1896 - DNA, 23 bp, synthetic construct
  source 1..23: mol_type = other DNA
gctgrtattccaggtgttccagg

SEQ ID NO: 1897 - DNA, 23 bp, synthetic construct
  source 1..23: mol_type = other DNA
cccrgacgacctggagagcgagg

SEQ ID NO: 1898 - DNA, 23 bp, synthetic construct
  source 1..23: mol_type = other DNA
cctgrtgaacctgggcaagctgg

SEQ ID NO: 1899 - DNA, 23 bp, synthetic construct
  source 1..23: mol_type = other DNA
actrgtcctattggtcctcctgg

SEQ ID NO: 1900 - DNA, 23 bp, synthetic construct
  source 1..23: mol_type = other DNA
aatrgtgctcctggactgcgagg

SEQ ID NO: 1901 - DNA, 23 bp, synthetic construct
  source 1..23: mol_type = other DNA
aaargcgaagatggcaaggatgg

SEQ ID NO: 1902 - DNA, 23 bp, synthetic construct
  source 1..23: mol_type = other DNA
agctaaargcgaagatggcaagg

SEQ ID NO: 1903 - DNA, 23 bp, synthetic construct
  source 1..23: mol_type = other DNA
ctgracctcagggacccccaggg

SEQ ID NO: 1904 - DNA, 23 bp, synthetic construct
  source 1..23: mol_type = other DNA
actgracctcagggacccccagg

SEQ ID NO: 1905 - DNA, 23 bp, synthetic construct
  source 1..23: mol_type = other DNA
ccargaccagccggtgctaatgg

SEQ ID NO: 1906 - DNA, 23 bp, synthetic construct
  source 1..23: mol_type = other DNA
caargaatgcctggagaaagagg

SEQ ID NO: 1907 - DNA, 23 bp, synthetic construct
  source 1..23: mol_type = other DNA
ccagrataccaaggaccccctgg

SEQ ID NO: 1908 - DNA, 23 bp, synthetic construct
  source 1..23: mol_type = other DNA
aaagrtgaaggaggccctcctgg

SEQ ID NO: 1909 - DNA, 23 bp, synthetic construct
  source 1..23: mol_type = other DNA
aaggrtgaaacaggtgctcctgg

SEQ ID NO: 1910 - DNA, 23 bp, synthetic construct
  source 1..23: mol_type = other DNA
taggracctgttggacccagtgg

SEQ ID NO: 1911 - DNA, 23 bp, synthetic construct
  source 1..23: mol_type = other DNA
gacrgtgctcgaggcagtgatgg

SEQ ID NO: 1912 - DNA, 23 bp, synthetic construct
  source 1..23: mol_type = other DNA
tcagrtagacccggacgacctgg

SEQ ID NO: 1913 - DNA, 23 bp, synthetic construct
  source 1..23: mol_type = other DNA
cctgragtgtctggaccaaaagg

SEQ ID NO: 1914 - DNA, 23 bp, synthetic construct
  source 1..23: mol_type = other DNA
caagrcccacgtggtgacaaagg

SEQ ID NO: 1915 - DNA, 23 bp, synthetic construct
  source 1..23: mol_type = other DNA
caggrccctcctggtcctcctgg

SEQ ID NO: 1916 - DNA, 23 bp, synthetic construct
  source 1..23: mol_type = other DNA
actrgagcacggggtcttgcagg

SEQ ID NO: 1917 - DNA, 23 bp, synthetic construct
  source 1..23: mol_type = other DNA
cctgrgccacctggtgctgctgg

SEQ ID NO: 1918 - DNA, 23 bp, synthetic construct
  source 1..23: mol_type = other DNA
cctgragaaagaggaggtcttgg

SEQ ID NO: 1919 - DNA, 23 bp, synthetic construct
  source 1..23: mol_type = other DNA
ccarggcaaccaggccctcctgg

SEQ ID NO: 1920 - DNA, 23 bp, synthetic construct
  source 1..23: mol_type = other DNA
agagrtgaaactggccctccagg

SEQ ID NO: 1921 - DNA, 23 bp, synthetic construct
  source 1..23: mol_type = other DNA
taggrtgctcctggtaagaatgg

SEQ ID NO: 1922 - DNA, 23 bp, synthetic construct
  source 1..23: mol_type = other DNA
gccrgtgctaatggtgctcctgg

SEQ ID NO: 1923 - DNA, 23 bp, synthetic construct
  source 1..23: mol_type = other DNA
agagragctgctggagaacctgg

SEQ ID NO: 1924 - DNA, 23 bp, synthetic construct
  source 1..23: mol_type = other DNA
gctrgtcctcctgggccacctgg

SEQ ID NO: 1925 - DNA, 23 bp, synthetic construct
  source 1..23: mol_type = other DNA
cctrgacaaagaggagaacctgg

SEQ ID NO: 1926 - DNA, 23 bp, synthetic construct
  source 1..23: mol_type = other DNA
caagraatgcctggagaaagagg

SEQ ID NO: 1927 - DNA, 23 bp, synthetic construct
  source 1..23: mol_type = other DNA
gctgrtccccctggtcccgaagg

SEQ ID NO: 1928 - DNA, 23 bp, synthetic construct
  source 1..23: mol_type = other DNA
cctrgtgaacctgggcaagctgg

SEQ ID NO: 1929 - DNA, 23 bp, synthetic construct
  source 1..23: mol_type = other DNA
ccagrccctcccggtccccctgg

SEQ ID NO: 1930 - DNA, 23 bp, synthetic construct
  source 1..23: mol_type = other DNA
actgrtgctcctggcagccctgg

SEQ ID NO: 1931 - DNA, 23 bp, synthetic construct
  source 1..23: mol_type = other DNA
tagrgcttcgatggacgaaatgg

SEQ ID NO: 1932 - DNA, 23 bp, synthetic construct
  source 1..23: mol_type = other DNA
ccctrgccctcagggtgtcaagg

SEQ ID NO: 1933 - DNA, 23 bp, synthetic construct
  source 1..23: mol_type = other DNA
cctgracctcctggtgcccctgg

SEQ ID NO: 1934 - DNA, 23 bp, synthetic construct
  source 1..23: mol_type = other DNA
ccttcgacttctctccagcygag

SEQ ID NO: 1935 - DNA, 23 bp, synthetic construct
  source 1..23: mol_type = other DNA
cctggtaagaatggagaaygagg

SEQ ID NO: 1936 - DNA, 23 bp, synthetic construct
  source 1..23: mol_type = other DNA
cccrgggagaaggggagcattgg

SEQ ID NO: 1937 - DNA, 23 bp, synthetic construct
  source 1..23: mol_type = other DNA
atgrggccaccggggactccagg

SEQ ID NO: 1938 - DNA, 23 bp, synthetic construct
  source 1..23: mol_type = other DNA
cctgraagagatggccatccggg

SEQ ID NO: 1939 - DNA, 23 bp, synthetic construct
  source 1..23: mol_type = other DNA
tcctgraagagatggccatccgg

SEQ ID NO: 1940 - DNA, 23 bp, synthetic construct
  source 1..23: mol_type = other DNA
tttcarggagagcctggagttgg

SEQ ID NO: 1941 - DNA, 23 bp, synthetic construct
  source 1..23: mol_type = other DNA
ccarggctgataggccagccagg

SEQ ID NO: 1942 - DNA, 23 bp, synthetic construct
  source 1..23: mol_type = other DNA
cctggagragttggattcccagg

SEQ ID NO: 1943 - DNA, 23 bp, synthetic construct
  source 1..23: mol_type = other DNA
aatgrcttacctgggaacccagg

SEQ ID NO: 1944 - DNA, 23 bp, synthetic construct
  source 1..23: mol_type = other DNA
cccrgcattcctggcacacccgg

SEQ ID NO: 1945 - DNA, 23 bp, synthetic construct
  source 1..23: mol_type = other DNA
cctgrtgtcaaaggagaagcagg

SEQ ID NO: 1946 - DNA, 23 bp, synthetic construct
  source 1..23: mol_type = other DNA
aaargagaccgcggacctcaggg

SEQ ID NO: 1947 - DNA, 23 bp, synthetic construct
  source 1..23: mol_type = other DNA
caaargagaccgcggacctcagg

SEQ ID NO: 1948 - DNA, 23 bp, synthetic construct
  source 1..23: mol_type = other DNA
ccttgatcacctttaattcyctg

SEQ ID NO: 1949 - DNA, 23 bp, synthetic construct
  source 1..23: mol_type = other DNA
cagrctttccagggctgactggg

SEQ ID NO: 1950 - DNA, 23 bp, synthetic construct
  source 1..23: mol_type = other DNA
ccagrctttccagggctgactgg

SEQ ID NO: 1951 - DNA, 23 bp, synthetic construct
  source 1..23: mol_type = other DNA
aaggragacatcggagtccccgg

SEQ ID NO: 1952 - DNA, 23 bp, synthetic construct
  source 1..23: mol_type = other DNA
cctrgtccagtgggaatacctgg

SEQ ID NO: 1953 - DNA, 23 bp, synthetic construct
  source 1..23: mol_type = other DNA
gatgrgctacctggtcctccagg

SEQ ID NO: 1954 - DNA, 23 bp, synthetic construct
  source 1..23: mol_type = other DNA
attrggttgcctgggttgcctgg

SEQ ID NO: 1955 - DNA, 23 bp, synthetic construct
  source 1..23: mol_type = other DNA
aggrgtcagaaaggtgatgaagg

SEQ ID NO: 1956 - DNA, 23 bp, synthetic construct
  source 1..23: mol_type = other DNA
cctgracctcctggacttgacgg

SEQ ID NO: 1957 - DNA, 23 bp, synthetic construct
  source 1..23: mol_type = other DNA
cctrggcttccagggcctcctgg

SEQ ID NO: 1958 - DNA, 23 bp, synthetic construct
  source 1..23: mol_type = other DNA
cagrgagagagagggtttccagg

SEQ ID NO: 1959 - DNA, 23 bp, synthetic construct
  source 1..23: mol_type = other DNA
caggrcattccaggagctccagg

SEQ ID NO: 1960 - DNA, 23 bp, synthetic construct
  source 1..23: mol_type = other DNA
ccagragctccaggtgctccagg

SEQ ID NO: 1961 - DNA, 23 bp, synthetic construct
  source 1..23: mol_type = other DNA
cctrgcactcctggacaggatgg

SEQ ID NO: 1962 - DNA, 23 bp, synthetic construct
  source 1..23: mol_type = other DNA
tttacctrgcactcctggacagg

SEQ ID NO: 1963 - DNA, 23 bp, synthetic construct
  source 1..23: mol_type = other DNA
gatrgattgccagggcttcctgg

SEQ ID NO: 1964 - DNA, 23 bp, synthetic construct
  source 1..23: mol_type = other DNA
cagrcctcccagggaatataggg

SEQ ID NO: 1965 - DNA, 23 bp, synthetic construct
  source 1..23: mol_type = other DNA
ccagrcctcccagggaatatagg

SEQ ID NO: 1966 - DNA, 23 bp, synthetic construct
  source 1..23: mol_type = other DNA
aaagrcatacaaggtgtggcagg

SEQ ID NO: 1967 - DNA, 23 bp, synthetic construct
  source 1..23: mol_type = other DNA
tgaaaaagrcatacaaggtgtgg

SEQ ID NO: 1968 - DNA, 23 bp, synthetic construct
  source 1..23: mol_type = other DNA
ccagracttccaggtttcaaagg

SEQ ID NO: 1969 - DNA, 23 bp, synthetic construct
  source 1..23: mol_type = other DNA
aaargagcacttggtccaaaagg

SEQ ID NO: 1970 - DNA, 23 bp, synthetic construct
  source 1..23: mol_type = other DNA
ccagrgattcctgggccaatagg

SEQ ID NO: 1971 - DNA, 23 bp, synthetic construct
  source 1..23: mol_type = other DNA
ccargacctttgggaattcctgg

SEQ ID NO: 1972 - DNA, 23 bp, synthetic construct
  source 1..23: mol_type = other DNA
ttgrgaattcctggcaggagtgg

SEQ ID NO: 1973 - DNA, 23 bp, synthetic construct
  source 1..23: mol_type = other DNA
gacctttgrgaattcctggcagg

SEQ ID NO: 1974 - DNA, 23 bp, synthetic construct
  source 1..23: mol_type = other DNA
cctrgacttcctggatttccagg

SEQ ID NO: 1975 - DNA, 23 bp, synthetic construct
  source 1..23: mol_type = other DNA
cctgracttccaggactttctgg

SEQ ID NO: 1976 - DNA, 23 bp, synthetic construct
  source 1..23: mol_type = other DNA
tagrgagaacgtggatttccagg

SEQ ID NO: 1977 - DNA, 23 bp, synthetic construct
  source 1..23: mol_type = other DNA
tcarggtaatcctggccggccgg

SEQ ID NO: 1978 - DNA, 23 bp, synthetic construct
  source 1..23: mol_type = other DNA
ttattcarggtaatcctggccgg

SEQ ID NO: 1979 - DNA, 23 bp, synthetic construct
  source 1..23: mol_type = other DNA
aaagragacccaggtctgccagg

SEQ ID NO: 1980 - DNA, 23 bp, synthetic construct
  source 1..23: mol_type = other DNA
tccagtaarttataaaatttggg

SEQ ID NO: 1981 - DNA, 23 bp, synthetic construct
  source 1..23: mol_type = other DNA
agtatgtraagctccagctgtgg

SEQ ID NO: 1982 - DNA, 23 bp, synthetic construct
  source 1..23: mol_type = other DNA
caggrtgagcaaggtcttcaggg

SEQ ID NO: 1983 - DNA, 23 bp, synthetic construct
  source 1..23: mol_type = other DNA
acaggrtgagcaaggtcttcagg

SEQ ID NO: 1984 - DNA, 23 bp, synthetic construct
  source 1..23: mol_type = other DNA
tagrgtaaaccaggcaaagatgg

SEQ ID NO: 1985 - DNA, 23 bp, synthetic construct
  source 1..23: mol_type = other DNA
ctgacargtcaaccaggctttgg

SEQ ID NO: 1986 - DNA, 23 bp, synthetic construct
  source 1..23: mol_type = other DNA
gtargtccaactggccctccagg

SEQ ID NO: 1987 - DNA, 23 bp, synthetic construct
  source 1..23: mol_type = other DNA
ccagrtttggaaggacacccagg

SEQ ID NO: 1988 - DNA, 23 bp, synthetic construct
  source 1..23: mol_type = other DNA
cccagraccaccaggtttgatgg

SEQ ID NO: 1989 - DNA, 23 bp, synthetic construct
  source 1..23: mol_type = other DNA
ccarggccaattggtcccccagg

SEQ ID NO: 1990 - DNA, 23 bp, synthetic construct
  source 1..23: mol_type = other DNA
attgrtcccccaggaccaccagg

SEQ ID NO: 1991 - DNA, 23 bp, synthetic construct
  source 1..23: mol_type = other DNA
cctgrtgaccgagggcctcctgg

SEQ ID NO: 1992 - DNA, 23 bp, synthetic construct
  source 1..23: mol_type = other DNA
aatatgrgcttaaatttccaggg

SEQ ID NO: 1993 - DNA, 23 bp, synthetic construct
  source 1..23: mol_type = other DNA
gaatatgrgcttaaatttccagg

SEQ ID NO: 1994 - DNA, 23 bp, synthetic construct
  source 1..23: mol_type = other DNA
aagrgtttgcctggtgatcctgg

SEQ ID NO: 1995 - DNA, 23 bp, synthetic construct
  source 1..23: mol_type = other DNA
cctgrttaccctggtgaacccgg

SEQ ID NO: 1996 - DNA, 23 bp, synthetic construct
  source 1..23: mol_type = other DNA
acccgraagggatggtgaaaagg

SEQ ID NO: 1997 - DNA, 23 bp, synthetic construct
  source 1..23: mol_type = other DNA
cctgrgttgcctggagaaaaagg

SEQ ID NO: 1998 - DNA, 23 bp, synthetic construct
  source 1..23: mol_type = other DNA
aaagragagcgaggatttcctgg

SEQ ID NO: 1999 - DNA, 23 bp, synthetic construct
  source 1..23: mol_type = other DNA
caggrtccacctggccttcctgg

SEQ ID NO: 2000 - DNA, 23 bp, synthetic construct
  source 1..23: mol_type = other DNA
aaagrtgatgaaggaccacctgg

SEQ ID NO: 2001 - DNA, 23 bp, synthetic construct
  source 1..23: mol_type = other DNA
ccacctrgaatttccattcctgg

SEQ ID NO: 2002 - DNA, 23 bp, synthetic construct
  source 1..23: mol_type = other DNA
cctgrccttcctggacctccagg

SEQ ID NO: 2003 - DNA, 23 bp, synthetic construct
  source 1..23: mol_type = other DNA
cctgratttcctggagaaagggg

SEQ ID NO: 2004 - DNA, 23 bp, synthetic construct
  source 1..23: mol_type = other DNA
tcctgratttcctggagaaaggg

SEQ ID NO: 2005 - DNA, 23 bp, synthetic construct
  source 1..23: mol_type = other DNA
ctcctgratttcctggagaaagg

SEQ ID NO: 2006 - DNA, 23 bp, synthetic construct
  source 1..23: mol_type = other DNA
ctgracttgacggacagcctggg

SEQ ID NO: 2007 - DNA, 23 bp, synthetic construct
  source 1..23: mol_type = other DNA
cctgracttgacggacagcctgg

SEQ ID NO: 2008 - DNA, 23 bp, synthetic construct
  source 1..23: mol_type = other DNA
gacrgacagcctggggctcctgg

SEQ ID NO: 2009 - DNA, 23 bp, synthetic construct
  source 1..23: mol_type = other DNA
ctgrggctcctgggcttccaggg

SEQ ID NO: 2010 - DNA, 23 bp, synthetic construct
  source 1..23: mol_type = other DNA
cctgrggctcctgggcttccagg

SEQ ID NO: 2011 - DNA, 23 bp, synthetic construct
  source 1..23: mol_type = other DNA
aaagractccaaggagaacaagg

SEQ ID NO: 2012 - DNA, 23 bp, synthetic construct
  source 1..23: mol_type = other DNA
caagragaacaaggagtgaaagg

SEQ ID NO: 2013 - DNA, 23 bp, synthetic construct
  source 1..23: mol_type = other DNA
tcagrgcctccaggtcaacctgg

SEQ ID NO: 2014 - DNA, 23 bp, synthetic construct
  source 1..23: mol_type = other DNA
ccagrtcaacctggtttgccagg

SEQ ID NO: 2015 - DNA, 23 bp, synthetic construct
  source 1..23: mol_type = other DNA
gctgrtgcaactggtcccaaagg

SEQ ID NO: 2016 - DNA, 23 bp, synthetic construct
  source 1..23: mol_type = other DNA
ccagrtgctccaggctttcctgg

SEQ ID NO: 2017 - DNA, 23 bp, synthetic construct
  source 1..23: mol_type = other DNA
ctgracaggatggattgccaggg

SEQ ID NO: 2018 - DNA, 23 bp, synthetic construct
  source 1..23: mol_type = other DNA
cctgracaggatggattgccagg

SEQ ID NO: 2019 - DNA, 23 bp, synthetic construct
  source 1..23: mol_type = other DNA
tagrgtggaattacttttaaggg

SEQ ID NO: 2020 - DNA, 23 bp, synthetic construct
  source 1..23: mol_type = other DNA
ttagrgtggaattacttttaagg

SEQ ID NO: 2021 - DNA, 23 bp, synthetic construct
  source 1..23: mol_type = other DNA
tagggtrgaattacttttaaggg

SEQ ID NO: 2022 - DNA, 23 bp, synthetic construct
  source 1..23: mol_type = other DNA
ttagggtrgaattacttttaagg

SEQ ID NO: 2023 - DNA, 23 bp, synthetic construct
  source 1..23: mol_type = other DNA
aaargagagttgggttcccctgg

SEQ ID NO: 2024 - DNA, 23 bp, synthetic construct
  source 1..23: mol_type = other DNA
cctgrtttacctggcactcctgg

SEQ ID NO: 2025 - DNA, 23 bp, synthetic construct
  source 1..23: mol_type = other DNA
cctrgacaggatggattgccagg

SEQ ID NO: 2026 - DNA, 23 bp, synthetic construct
  source 1..23: mol_type = other DNA
ccccctgrtttcggccctccagg

SEQ ID NO: 2027 - DNA, 23 bp, synthetic construct
  source 1..23: mol_type = other DNA
ccagrcccagtaggtgaaaaagg

SEQ ID NO: 2028 - DNA, 23 bp, synthetic construct
  source 1..23: mol_type = other DNA
gtagrtgaaaaaggcatacaagg

SEQ ID NO: 2029 - DNA, 23 bp, synthetic construct
  source 1..23: mol_type = other DNA
gtaggtraaaaaggcatacaagg

SEQ ID NO: 2030 - DNA, 23 bp, synthetic construct
  source 1..23: mol_type = other DNA
caargtgtggcaggaaatccagg

SEQ ID NO: 2031 - DNA, 23 bp, synthetic construct
  source 1..23: mol_type = other DNA
gatrgtgatgtaggtcttccagg

SEQ ID NO: 2032 - DNA, 23 bp, synthetic construct
  source 1..23: mol_type = other DNA
tagrtgaccctggacttccaggg

SEQ ID NO: 2033 - DNA, 23 bp, synthetic construct
  source 1..23: mol_type = other DNA
atagrtgaccctggacttccagg

SEQ ID NO: 2034 - DNA, 23 bp, synthetic construct
  source 1..23: mol_type = other DNA
cagracctccaggagcacctggg

SEQ ID NO: 2035 - DNA, 23 bp, synthetic construct
  source 1..23: mol_type = other DNA
ccagracctccaggagcacctgg

SEQ ID NO: 2036 - DNA, 23 bp, synthetic construct
  source 1..23: mol_type = other DNA
cctgrgccacccggctttccagg

SEQ ID NO: 2037 - DNA, 23 bp, synthetic construct
  source 1..23: mol_type = other DNA
acccgrctttccaggaccaaagg

SEQ ID NO: 2038 - DNA, 23 bp, synthetic construct
  source 1..23: mol_type = other DNA
cagrgcaaccaggcttgccaggg

SEQ ID NO: 2039 - DNA, 23 bp, synthetic construct
  source 1..23: mol_type = other DNA
ccagrgcaaccaggcttgccagg

SEQ ID NO: 2040 - DNA, 23 bp, synthetic construct
  source 1..23: mol_type = other DNA
ccargacttccaggtttcaaagg

SEQ ID NO: 2041 - DNA, 23 bp, synthetic construct
  source 1..23: mol_type = other DNA
ccagrtttcaaaggagcacttgg

SEQ ID NO: 2042 - DNA, 23 bp, synthetic construct
  source 1..23: mol_type = other DNA
cgtrgtttcccaggacctccggg

SEQ ID NO: 2043 - DNA, 23 bp, synthetic construct
  source 1..23: mol_type = other DNA
tcgtrgtttcccaggacctccgg

SEQ ID NO: 2044 - DNA, 23 bp, synthetic construct
  source 1..23: mol_type = other DNA
ccctrgaccaaaaggtatggagg

SEQ ID NO: 2045 - DNA, 23 bp, synthetic construct
  source 1..23: mol_type = other DNA
gctccctrgaccaaaaggtatgg

SEQ ID NO: 2046 - DNA, 23 bp, synthetic construct
  source 1..23: mol_type = other DNA
gttrgaccaaatggacaacctgg

SEQ ID NO: 2047 - DNA, 23 bp, synthetic construct
  source 1..23: mol_type = other DNA
ctgraccaatgggacctcctggg

SEQ ID NO: 2048 - DNA, 23 bp, synthetic construct
  source 1..23: mol_type = other DNA
cctgraccaatgggacctcctgg

SEQ ID NO: 2049 - DNA, 23 bp, synthetic construct
  source 1..23: mol_type = other DNA
atgrgacctcctgggctgccagg

SEQ ID NO: 2050 - DNA, 23 bp, synthetic construct
  source 1..23: mol_type = other DNA
cctcctrgacttgatgttccagg

SEQ ID NO: 2051 - DNA, 23 bp, synthetic construct
  source 1..23: mol_type = other DNA
cctcctgracttgatgttccagg

SEQ ID NO: 2052 - DNA, 23 bp, synthetic construct
  source 1..23: mol_type = other DNA
ccagrgatccccggagcacctgg

SEQ ID NO: 2053 - DNA, 23 bp, synthetic construct
  source 1..23: mol_type = other DNA
cccrgagcacctggtcctatagg

SEQ ID NO: 2054 - DNA, 23 bp, synthetic construct
  source 1..23: mol_type = other DNA
tagracctccaggatcaccaggg

SEQ ID NO: 2055 - DNA, 23 bp, synthetic construct
  source 1..23: mol_type = other DNA
atagracctccaggatcaccagg

SEQ ID NO: 2056 - DNA, 23 bp, synthetic construct
  source 1..23: mol_type = other DNA
cctgrccctacaggagaaaaagg

SEQ ID NO: 2057 - DNA, 23 bp, synthetic construct
  source 1..23: mol_type = other DNA
atcrgtgatatgggttttccagg

SEQ ID NO: 2058 - DNA, 23 bp, synthetic construct
  source 1..23: mol_type = other DNA
cagrgtgtggaagggcctcctgg

SEQ ID NO: 2059 - DNA, 23 bp, synthetic construct
  source 1..23: mol_type = other DNA
cctgraccttctggagttcctgg

SEQ ID NO: 2060 - DNA, 23 bp, synthetic construct
  source 1..23: mol_type = other DNA
cagrgtgagcctggtctgcctgg

SEQ ID NO: 2061 - DNA, 23 bp, synthetic construct
  source 1..23: mol_type = other DNA
cccrgattaccaggaacccctgg

SEQ ID NO: 2062 - DNA, 23 bp, synthetic construct
  source 1..23: mol_type = other DNA
cccrgccttccaggagaacctgg

SEQ ID NO: 2063 - DNA, 23 bp, synthetic construct
  source 1..23: mol_type = other DNA
cccgrccttccaggagaacctgg

SEQ ID NO: 2064 - DNA, 23 bp, synthetic construct
  source 1..23: mol_type = other DNA
ctgrtctgcctggatacccaggg

SEQ ID NO: 2065 - DNA, 23 bp, synthetic construct
  source 1..23: mol_type = other DNA
cctgrtctgcctggatacccagg

SEQ ID NO: 2066 - DNA, 23 bp, synthetic construct
  source 1..23: mol_type = other DNA
ccarggcctccaggcgaaaaagg

SEQ ID NO: 2067 - DNA, 23 bp, synthetic construct
  source 1..23: mol_type = other DNA
aaargcaaacccggtcaagatgg

SEQ ID NO: 2068 - DNA, 23 bp, synthetic construct
  source 1..23: mol_type = other DNA
cccrgtcaagatggtattcctgg

SEQ ID NO: 2069 - DNA, 23 bp, synthetic construct
  source 1..23: mol_type = other DNA
gctrgacagaagggtgaaccagg

SEQ ID NO: 2070 - DNA, 23 bp, synthetic construct
  source 1..23: mol_type = other DNA
cctrgacttccaggactttctgg

SEQ ID NO: 2071 - DNA, 23 bp, synthetic construct
  source 1..23: mol_type = other DNA
cctgrgattccaggaaatcctgg

SEQ ID NO: 2072 - DNA, 23 bp, synthetic construct
  source 1..23: mol_type = other DNA
ccagraaatcctggccttccagg

SEQ ID NO: 2073 - DNA, 23 bp, synthetic construct
  source 1..23: mol_type = other DNA
cctrgtgtgcagggtcccccagg

SEQ ID NO: 2074 - DNA, 23 bp, synthetic construct
  source 1..23: mol_type = other DNA
ccagrtccaaagggcgaaccagg

SEQ ID NO: 2075 - DNA, 23 bp, synthetic construct
  source 1..23: mol_type = other DNA
cacgrtttccctggtgtgcaggg

SEQ ID NO: 2076 - DNA, 23 bp, synthetic construct
  source 1..23: mol_type = other DNA
tcacgrtttccctggtgtgcagg

SEQ ID NO: 2077 - DNA, 23 bp, synthetic construct
  source 1..23: mol_type = other DNA
gaargtcctccaggtctccctgg

SEQ ID NO: 2078 - DNA, 23 bp, synthetic construct
  source 1..23: mol_type = other DNA
tctccggrtccagctctggaagg

SEQ ID NO: 2079 - DNA, 23 bp, synthetic construct
  source 1..23: mol_type = other DNA
aaargcaaccctgggccccaagg

SEQ ID NO: 2080 - DNA, 23 bp, synthetic construct
  source 1..23: mol_type = other DNA
cctrggccccaaggtcctcctgg

SEQ ID NO: 2081 - DNA, 23 bp, synthetic construct
  source 1..23: mol_type = other DNA
caargtcccccaggtccccctgg

SEQ ID NO: 2082 - DNA, 23 bp, synthetic construct
  source 1..23: mol_type = other DNA
gattgrttattccttcatgatgg

SEQ ID NO: 2083 - DNA, 23 bp, synthetic construct
  source 1..23: mol_type = other DNA
tccagrtaaattatgcctcaggg

SEQ ID NO: 2084 - DNA, 23 bp, synthetic construct
  source 1..23: mol_type = other DNA
ctccagrtaaattatgcctcagg

SEQ ID NO: 2085 - DNA, 23 bp, synthetic construct
  source 1..23: mol_type = other DNA
ttarggtggaattacttttaagg

SEQ ID NO: 2086 - DNA, 23 bp, synthetic construct
  source 1..23: mol_type = other DNA
atggracctccaggcccaccagg

SEQ ID NO: 2087 - DNA, 23 bp, synthetic construct
  source 1..23: mol_type = other DNA
ttggraattcctggcaggagtgg

SEQ ID NO: 2088 - DNA, 23 bp, synthetic construct
  source 1..23: mol_type = other DNA
cctgrccttccaggccctcctgg

SEQ ID NO: 2089 - DNA, 23 bp, synthetic construct
  source 1..23: mol_type = other DNA
ctargtcccaaaggtaaccctgg

SEQ ID NO: 2090 - DNA, 23 bp, synthetic construct
  source 1..23: mol_type = other DNA
atargccaaaagggtgatggagg

SEQ ID NO: 2091 - DNA, 23 bp, synthetic construct
  source 1..23: mol_type = other DNA
ttcatargccaaaagggtgatgg

SEQ ID NO: 2092 - DNA, 23 bp, synthetic construct
  source 1..23: mol_type = other DNA
caagrtggagagaagggtattgg

SEQ ID NO: 2093 - DNA, 23 bp, synthetic construct
  source 1..23: mol_type = other DNA
ccagrgaatatagggcctatggg

SEQ ID NO: 2094 - DNA, 23 bp, synthetic construct
  source 1..23: mol_type = other DNA
cccagrgaatatagggcctatgg

SEQ ID NO: 2095 - DNA, 23 bp, synthetic construct
  source 1..23: mol_type = other DNA
cctggcactcctggayaggatgg

SEQ ID NO: 2096 - DNA, 23 bp, synthetic construct
  source 1..23: mol_type = other DNA
cccagggaatatagggcytatgg

SEQ ID NO: 2097 - DNA, 23 bp, synthetic construct
  source 1..23: mol_type = other DNA
ccagggaatatagggcytatggg

SEQ ID NO: 2098 - DNA, 23 bp, synthetic construct
  source 1..23: mol_type = other DNA
cctccaggaatccctggcyagcc

SEQ ID NO: 2099 - DNA, 23 bp, synthetic construct
  source 1..23: mol_type = other DNA
ccaggaatccctggcyagcctgg

SEQ ID NO: 2100 - DNA, 23 bp, synthetic construct
  source 1..23: mol_type = other DNA
cctggagaaaggggtyagaaagg

SEQ ID NO: 2101 - DNA, 23 bp, synthetic construct
  source 1..23: mol_type = other DNA
cctggagaaaaaggagagygagg

SEQ ID NO: 2102 - DNA, 23 bp, synthetic construct
  source 1..23: mol_type = other DNA
ccctggtctccctggayagccag

SEQ ID NO: 2103 - DNA, 23 bp, synthetic construct
  source 1..23: mol_type = other DNA
cctggtctccctggayagccagg

SEQ ID NO: 2104 - DNA, 23 bp, synthetic construct
  source 1..23: mol_type = other DNA
ccccaggattacctggayagaaa

SEQ ID NO: 2105 - DNA, 23 bp, synthetic construct
  source 1..23: mol_type = other DNA
cccaggattacctggayagaaag

SEQ ID NO: 2106 - DNA, 23 bp, synthetic construct
  source 1..23: mol_type = other DNA
ccaggattacctggayagaaagg

SEQ ID NO: 2107 - DNA, 23 bp, synthetic construct
  source 1..23: mol_type = other DNA
cctggaccagctggayagaaggg

SEQ ID NO: 2108 - DNA, 23 bp, synthetic construct
  source 1..23: mol_type = other DNA
ccctccaggagatcctggaygca

SEQ ID NO: 2109 - DNA, 23 bp, synthetic construct
  source 1..23: mol_type = other DNA
cctccaggagatcctggaygcaa

SEQ ID NO: 2110 - DNA, 23 bp, synthetic construct
  source 1..23: mol_type = other DNA
ccaggagatcctggaygcaatgg

SEQ ID NO: 2111 - DNA, 23 bp, synthetic construct
  source 1..23: mol_type = other DNA
ccagccattcattagtyggtaag

SEQ ID NO: 2112 - DNA, 23 bp, synthetic construct
  source 1..23: mol_type = other DNA
ggcrgcgatgcgggctccaaagg

SEQ ID NO: 2113 - DNA, 23 bp, synthetic construct
  source 1..23: mol_type = other DNA
ccagrcctgccaggctgcaaggg

SEQ ID NO: 2114 - DNA, 23 bp, synthetic construct
  source 1..23: mol_type = other DNA
cccagrcctgccaggctgcaagg

SEQ ID NO: 2115 - DNA, 23 bp, synthetic construct
  source 1..23: mol_type = other DNA
aaggrcaacatgggtgagccggg

SEQ ID NO: 2116 - DNA, 23 bp, synthetic construct
  source 1..23: mol_type = other DNA
caaggrcaacatgggtgagccgg

SEQ ID NO: 2117 - DNA, 23 bp, synthetic construct
  source 1..23: mol_type = other DNA
aagrgcaacatgggtgagccggg

SEQ ID NO: 2118 - DNA, 23 bp, synthetic construct
  source 1..23: mol_type = other DNA
caagrgcaacatgggtgagccgg

SEQ ID NO: 2119 - DNA, 23 bp, synthetic construct
  source 1..23: mol_type = other DNA
caggragacccgggcatcgaagg

SEQ ID NO: 2120 - DNA, 23 bp, synthetic construct
  source 1..23: mol_type = other DNA
gaargccccattggattcccagg

SEQ ID NO: 2121 - DNA, 23 bp, synthetic construct
  source 1..23: mol_type = other DNA
atcracagctccgagagcattgg

SEQ ID NO: 2122 - DNA, 23 bp, synthetic construct
  source 1..23: mol_type = other DNA
tcctccarggagaccccggcagg

SEQ ID NO: 2123 - DNA, 23 bp, synthetic construct
  source 1..23: mol_type = other DNA
cctgctggacggctccgagyggc

SEQ ID NO: 2124 - DNA, 23 bp, synthetic construct
  source 1..23: mol_type = other DNA
cccagaccttccctgcyaaacag

SEQ ID NO: 2125 - DNA, 23 bp, synthetic construct
  source 1..23: mol_type = other DNA
ccagaccttccctgcyaaacagg

SEQ ID NO: 2126 - DNA, 23 bp, synthetic construct
  source 1..23: mol_type = other DNA
ccatcgtgcgcagccygcgtggc

SEQ ID NO: 2127 - DNA, 23 bp, synthetic construct
  source 1..23: mol_type = other DNA
aacgrcactcaaggtttccaggg

SEQ ID NO: 2128 - DNA, 23 bp, synthetic construct
  source 1..23: mol_type = other DNA
gaacgrcactcaaggtttccagg

SEQ ID NO: 2129 - DNA, 23 bp, synthetic construct
  source 1..23: mol_type = other DNA
aagrtgaggcgtgggtgatgggg

SEQ ID NO: 2130 - DNA, 23 bp, synthetic construct
  source 1..23: mol_type = other DNA
aaagrtgaggcgtgggtgatggg

SEQ ID NO: 2131 - DNA, 23 bp, synthetic construct
  source 1..23: mol_type = other DNA
taaagrtgaggcgtgggtgatgg

SEQ ID NO: 2132 - DNA, 23 bp, synthetic construct
  source 1..23: mol_type = other DNA
ccaacttcaatgccatcygagac

SEQ ID NO: 2133 - DNA, 23 bp, synthetic construct
  source 1..23: mol_type = other DNA
cctrgtattcccgggctcccagg

SEQ ID NO: 2134 - DNA, 23 bp, synthetic construct
  source 1..23: mol_type = other DNA
cgcrggctgaagggcgaccgtgg

SEQ ID NO: 2135 - DNA, 23 bp, synthetic construct
  source 1..23: mol_type = other DNA
cccrggctcccaggcagggctgg

SEQ ID NO: 2136 - DNA, 23 bp, synthetic construct
  source 1..23: mol_type = other DNA
tattcccrggctcccaggcaggg

SEQ ID NO: 2137 - DNA, 23 bp, synthetic construct
  source 1..23: mol_type = other DNA
gtattcccrggctcccaggcagg

SEQ ID NO: 2138 - DNA, 23 bp, synthetic construct
  source 1..23: mol_type = other DNA
cagrggtctccaggtttgcctgg

SEQ ID NO: 2139 - DNA, 23 bp, synthetic construct
  source 1..23: mol_type = other DNA
tccrgccttgccggggagcctgg

SEQ ID NO: 2140 - DNA, 23 bp, synthetic construct
  source 1..23: mol_type = other DNA
gtcrgacctaaaggagaacctgg

SEQ ID NO: 2141 - DNA, 23 bp, synthetic construct
  source 1..23: mol_type = other DNA
aaggrcgaccgtggagaccctgg

SEQ ID NO: 2142 - DNA, 23 bp, synthetic construct
  source 1..23: mol_type = other DNA
ccctcaggrgccacctggtctgg

SEQ ID NO: 2143 - DNA, 23 bp, synthetic construct
  source 1..23: mol_type = other DNA
gccrgggagcctggaaagcctgg

SEQ ID NO: 2144 - DNA, 23 bp, synthetic construct
  source 1..23: mol_type = other DNA
ctgraaagcctggtattcccggg

SEQ ID NO: 2145 - DNA, 23 bp, synthetic construct
  source 1..23: mol_type = other DNA
cctgraaagcctggtattcccgg

SEQ ID NO: 2146 - DNA, 23 bp, synthetic construct
  source 1..23: mol_type = other DNA
gatgrccctcctggactccctgg

SEQ ID NO: 2147 - DNA, 23 bp, synthetic construct
  source 1..23: mol_type = other DNA
cccrggctggcaggacacaaagg

SEQ ID NO: 2148 - DNA, 23 bp, synthetic construct
  source 1..23: mol_type = other DNA
caggrgccaccaggacccactgg

SEQ ID NO: 2149 - DNA, 23 bp, synthetic construct
  source 1..23: mol_type = other DNA
cccaggacctgttggccccygag

SEQ ID NO: 2150 - DNA, 23 bp, synthetic construct
  source 1..23: mol_type = other DNA
ccaggacctgttggccccygagg

SEQ ID NO: 2151 - DNA, 23 bp, synthetic construct
  source 1..23: mol_type = other DNA
cctacccctccagggtgacygag

SEQ ID NO: 2152 - DNA, 23 bp, synthetic construct
  source 1..23: mol_type = other DNA
cccctccagggtgacygaggtcc

SEQ ID NO: 2153 - DNA, 23 bp, synthetic construct
  source 1..23: mol_type = other DNA
ccctccagggtgacygaggtcct

SEQ ID NO: 2154 - DNA, 23 bp, synthetic construct
  source 1..23: mol_type = other DNA
cttcatcrgcatcaacgacctgg

SEQ ID NO: 2155 - DNA, 23 bp, synthetic construct
  source 1..23: mol_type = other DNA
catgcggrgtggccgcctggggg

SEQ ID NO: 2156 - DNA, 23 bp, synthetic construct
  source 1..23: mol_type = other DNA
ccatgcggrgtggccgcctgggg

SEQ ID NO: 2157 - DNA, 23 bp, synthetic construct
  source 1..23: mol_type = other DNA
catgcgggrtggccgcctggggg

SEQ ID NO: 2158 - DNA, 23 bp, synthetic construct
  source 1..23: mol_type = other DNA
gccaatcrtccaatagccgctgg

SEQ ID NO: 2159 - DNA, 23 bp, synthetic construct
  source 1..23: mol_type = other DNA
cctgtactatgagcggygctggg

SEQ ID NO: 2160 - DNA, 23 bp, synthetic construct
  source 1..23: mol_type = other DNA
agcgtrtgggcattgtggcctgg

SEQ ID NO: 2161 - DNA, 23 bp, synthetic construct
  source 1..23: mol_type = other DNA
cccatgacatccctygggtcagt

SEQ ID NO: 2162 - DNA, 23 bp, synthetic construct
  source 1..23: mol_type = other DNA
ccartgaatatatctttagtggg

SEQ ID NO: 2163 - DNA, 23 bp, synthetic construct
  source 1..23: mol_type = other DNA
cccartgaatatatctttagtgg

SEQ ID NO: 2164 - DNA, 23 bp, synthetic construct
  source 1..23: mol_type = other DNA
ccccctgattgtttgtygaagac

SEQ ID NO: 2165 - DNA, 23 bp, synthetic construct
  source 1..23: mol_type = other DNA
cccctgattgtttgtygaagacc

SEQ ID NO: 2166 - DNA, 23 bp, synthetic construct
  source 1..23: mol_type = other DNA
ccctgattgtttgtygaagacct

SEQ ID NO: 2167 - DNA, 23 bp, synthetic construct
  source 1..23: mol_type = other DNA
ttctattgrcatccactccacgg

SEQ ID NO: 2168 - DNA, 23 bp, synthetic construct
  source 1..23: mol_type = other DNA
cccatcgtggagaayggcggggc

SEQ ID NO: 2169 - DNA, 23 bp, synthetic construct
  source 1..23: mol_type = other DNA
ccccgcgcctggtccyagtgcgg

SEQ ID NO: 2170 - DNA, 23 bp, synthetic construct
  source 1..23: mol_type = other DNA
cccgcgcctggtccyagtgcggc

SEQ ID NO: 2171 - DNA, 23 bp, synthetic construct
  source 1..23: mol_type = other DNA
cagcgragggggctttggaccgg

SEQ ID NO: 2172 - DNA, 23 bp, synthetic construct
  source 1..23: mol_type = other DNA
cagcggagrgggctttggaccgg

SEQ ID NO: 2173 - DNA, 23 bp, synthetic construct
  source 1..23: mol_type = other DNA
ctgrgcagatgcgccgatcgtgg

SEQ ID NO: 2174 - DNA, 23 bp, synthetic construct
  source 1..23: mol_type = other DNA
ccctcatcgtcaccatgygctac

SEQ ID NO: 2175 - DNA, 23 bp, synthetic construct
  source 1..23: mol_type = other DNA
cctcatcgtcaccatgygctact

SEQ ID NO: 2176 - DNA, 23 bp, synthetic construct
  source 1..23: mol_type = other DNA
cctgggcagatgcgcygatcgtg

SEQ ID NO: 2177 - DNA, 23 bp, synthetic construct
  source 1..23: mol_type = other DNA
cctgaccagtgagaacygagaca

SEQ ID NO: 2178 - DNA, 23 bp, synthetic construct
  source 1..23: mol_type = other DNA
ccgcactgagaccatcygcccgg

SEQ ID NO: 2179 - DNA, 23 bp, synthetic construct
  source 1..23: mol_type = other DNA
ccatgtttgtccgaaygcttcaa

SEQ ID NO: 2180 - DNA, 23 bp, synthetic construct
  source 1..23: mol_type = other DNA
ccgttgcgactgtgccyggcccc

SEQ ID NO: 2181 - DNA, 23 bp, synthetic construct
  source 1..23: mol_type = other DNA
ccagcagccccgtgyagcagggc

SEQ ID NO: 2182 - DNA, 23 bp, synthetic construct
  source 1..23: mol_type = other DNA
ccaggtgaccccgcagcctyaaa

SEQ ID NO: 2183 - DNA, 23 bp, synthetic construct
  source 1..23: mol_type = other DNA
cctagaagcactgtatcgayagg

SEQ ID NO: 2184 - DNA, 23 bp, synthetic construct
  source 1..23: mol_type = other DNA
ccggggaggtttttgtcygagtg

SEQ ID NO: 2185 - DNA, 23 bp, synthetic construct
  source 1..23: mol_type = other DNA
ccatagcttaattaatyaggctt

SEQ ID NO: 2186 - DNA, 23 bp, synthetic construct
  source 1..23: mol_type = other DNA
ccccttccccagcagyagcccat

SEQ ID NO: 2187 - DNA, 23 bp, synthetic construct
  source 1..23: mol_type = other DNA
cccttccccagcagyagcccatg

SEQ ID NO: 2188 - DNA, 23 bp, synthetic construct
  source 1..23: mol_type = other DNA
ttggccrtaagttggcacccagg

SEQ ID NO: 2189 - DNA, 23 bp, synthetic construct
  source 1..23: mol_type = other DNA
ccccgcaggtggtatggcyagga

SEQ ID NO: 2190 - DNA, 23 bp, synthetic construct
  source 1..23: mol_type = other DNA
cccgcaggtggtatggcyaggac

SEQ ID NO: 2191 - DNA, 23 bp, synthetic construct
  source 1..23: mol_type = other DNA
ccgcaggtggtatggcyaggaca

SEQ ID NO: 2192 - DNA, 23 bp, synthetic construct
  source 1..23: mol_type = other DNA
ccagtgcccccagagaaacycgt

SEQ ID NO: 2193 - DNA, 23 bp, synthetic construct
  source 1..23: mol_type = other DNA
gatrgagccggggcgccgggggg

SEQ ID NO: 2194 - DNA, 23 bp, synthetic construct
  source 1..23: mol_type = other DNA
cgatrgagccggggcgccggggg

SEQ ID NO: 2195 - DNA, 23 bp, synthetic construct
  source 1..23: mol_type = other DNA
gcgatrgagccggggcgccgggg

SEQ ID NO: 2196 - DNA, 23 bp, synthetic construct
  source 1..23: mol_type = other DNA
cgcgatrgagccggggcgccggg

SEQ ID NO: 2197 - DNA, 23 bp, synthetic construct
  source 1..23: mol_type = other DNA
gcgcgatrgagccggggcgccgg

SEQ ID NO: 2198 - DNA, 23 bp, synthetic construct
  source 1..23: mol_type = other DNA
cccccaggaagcagcggygggag

SEQ ID NO: 2199 - DNA, 23 bp, synthetic construct
  source 1..23: mol_type = other DNA
ccccaggaagcagcggygggagc

SEQ ID NO: 2200 - DNA, 23 bp, synthetic construct
  source 1..23: mol_type = other DNA
cccaggaagcagcggygggagcg

SEQ ID NO: 2201 - DNA, 23 bp, synthetic construct
  source 1..23: mol_type = other DNA
ccaggaagcagcggygggagcgc

SEQ ID NO: 2202 - DNA, 23 bp, synthetic construct
  source 1..23: mol_type = other DNA
ccaggtttggttcaagaacygga

SEQ ID NO: 2203 - DNA, 23 bp, synthetic construct
  source 1..23: mol_type = other DNA
cctgrttcaagcgcaccctgggg

SEQ ID NO: 2204 - DNA, 23 bp, synthetic construct
  source 1..23: mol_type = other DNA
ccctgrttcaagcgcaccctggg

SEQ ID NO: 2205 - DNA, 23 bp, synthetic construct
  source 1..23: mol_type = other DNA
cccctgrttcaagcgcaccctgg

SEQ ID NO: 2206 - DNA, 23 bp, synthetic construct
  source 1..23: mol_type = other DNA
ccgccagtccctcttcygcaccg

SEQ ID NO: 2207 - DNA, 23 bp, synthetic construct
  source 1..23: mol_type = other DNA
ccagcacccctggttcaagygca

SEQ ID NO: 2208 - DNA, 23 bp, synthetic construct
  source 1..23: mol_type = other DNA
cccgtgagttccacygccgctac

SEQ ID NO: 2209 - DNA, 23 bp, synthetic construct
  source 1..23: mol_type = other DNA
ccatcagcccctactacygccag

SEQ ID NO: 2210 - DNA, 23 bp, synthetic construct
  source 1..23: mol_type = other DNA
ccaccctccttcctgygggcacc

SEQ ID NO: 2211 - DNA, 23 bp, synthetic construct
  source 1..23: mol_type = other DNA
gcctrtacccatggaggtaaggg

SEQ ID NO: 2212 - DNA, 23 bp, synthetic construct
  source 1..23: mol_type = other DNA
agcctrtacccatggaggtaagg

SEQ ID NO: 2213 - DNA, 23 bp, synthetic construct
  source 1..23: mol_type = other DNA
cgtaacrtgctgttgaccaatgg

SEQ ID NO: 2214 - DNA, 23 bp, synthetic construct
  source 1..23: mol_type = other DNA
ccctcgragctggagcctttggg

SEQ ID NO: 2215 - DNA, 23 bp, synthetic construct
  source 1..23: mol_type = other DNA
accctcgragctggagcctttgg

SEQ ID NO: 2216 - DNA, 23 bp, synthetic construct
  source 1..23: mol_type = other DNA
ccctcagtgcatccacygggacg

SEQ ID NO: 2217 - DNA, 23 bp, synthetic construct
  source 1..23: mol_type = other DNA
cctcagtgcatccacygggacgt

SEQ ID NO: 2218 - DNA, 23 bp, synthetic construct
  source 1..23: mol_type = other DNA
cctgtgaagtggatggycccaga

SEQ ID NO: 2219 - DNA, 23 bp, synthetic construct
  source 1..23: mol_type = other DNA
cctacaccctgcagataygctgc

SEQ ID NO: 2220 - DNA, 23 bp, synthetic construct
  source 1..23: mol_type = other DNA
cctcaccctgatgaycttgaccc

SEQ ID NO: 2221 - DNA, 23 bp, synthetic construct
  source 1..23: mol_type = other DNA
cccgcgrccggctccagtcccgg

SEQ ID NO: 2222 - DNA, 23 bp, synthetic construct
  source 1..23: mol_type = other DNA
cacctrgctcttgaatgacacgg

SEQ ID NO: 2223 - DNA, 23 bp, synthetic construct
  source 1..23: mol_type = other DNA
ccacrtgtccatcatcgtgcagg

SEQ ID NO: 2224 - DNA, 23 bp, synthetic construct
  source 1..23: mol_type = other DNA
ccattctggtgccactaycacag

SEQ ID NO: 2225 - DNA, 23 bp, synthetic construct
  source 1..23: mol_type = other DNA
ccgcagggtgaggctgaygttgg

SEQ ID NO: 2226 - DNA, 23 bp, synthetic construct
  source 1..23: mol_type = other DNA
tcactgccrcccactgcatcagg

SEQ ID NO: 2227 - DNA, 23 bp, synthetic construct
  source 1..23: mol_type = other DNA
ccggtagtctacaccygggtgtc

SEQ ID NO: 2228 - DNA, 23 bp, synthetic construct
  source 1..23: mol_type = other DNA
ccccaatcctaagccctyaggag

SEQ ID NO: 2229 - DNA, 23 bp, synthetic construct
  source 1..23: mol_type = other DNA
cccaatcctaagccctyaggagg

SEQ ID NO: 2230 - DNA, 23 bp, synthetic construct
  source 1..23: mol_type = other DNA
ccaatcctaagccctyaggaggt

SEQ ID NO: 2231 - DNA, 23 bp, synthetic construct
  source 1..23: mol_type = other DNA
ccaggacactgtgtyggtgagtc

SEQ ID NO: 2232 - DNA, 23 bp, synthetic construct
  source 1..23: mol_type = other DNA
aaccrtctcagtcacactgaggg

SEQ ID NO: 2233 - DNA, 23 bp, synthetic construct
  source 1..23: mol_type = other DNA
caaccrtctcagtcacactgagg

SEQ ID NO: 2234 - DNA, 23 bp, synthetic construct
  source 1..23: mol_type = other DNA
ccaggaaaatcataaygttgtag

SEQ ID NO: 2235 - DNA, 23 bp, synthetic construct
  source 1..23: mol_type = other DNA
cctctccaaaggaaagygaggtg

SEQ ID NO: 2236 - DNA, 23 bp, synthetic construct
  source 1..23: mol_type = other DNA
cttcrtggacctggtcatcaagg

SEQ ID NO: 2237 - DNA, 23 bp, synthetic construct
  source 1..23: mol_type = other DNA
gtcrgatggcgaacttccctggg

SEQ ID NO: 2238 - DNA, 23 bp, synthetic construct
  source 1..23: mol_type = other DNA
ggtcrgatggcgaacttccctgg

SEQ ID NO: 2239 - DNA, 23 bp, synthetic construct
  source 1..23: mol_type = other DNA
cccgttctgtcctgcaggcyagc

SEQ ID NO: 2240 - DNA, 23 bp, synthetic construct
  source 1..23: mol_type = other DNA
ccgttctgtcctgcaggcyagca

SEQ ID NO: 2241 - DNA, 23 bp, synthetic construct
  source 1..23: mol_type = other DNA
ccaagggattccgaccygaatca

SEQ ID NO: 2242 - DNA, 23 bp, synthetic construct
  source 1..23: mol_type = other DNA
ttttrctcgaaagagaataaagg

SEQ ID NO: 2243 - DNA, 23 bp, synthetic construct
  source 1..23: mol_type = other DNA
tccragaggtgcttcgcctcagg

SEQ ID NO: 2244 - DNA, 23 bp, synthetic construct
  source 1..23: mol_type = other DNA
gggcrgcctcaaatggtaagtgg

SEQ ID NO: 2245 - DNA, 23 bp, synthetic construct
  source 1..23: mol_type = other DNA
gctgcatcraaggctggcgatgg

SEQ ID NO: 2246 - DNA, 23 bp, synthetic construct
  source 1..23: mol_type = other DNA
agcrtttcttgaatccagcgggg

SEQ ID NO: 2247 - DNA, 23 bp, synthetic construct
  source 1..23: mol_type = other DNA
gagcrtttcttgaatccagcggg

SEQ ID NO: 2248 - DNA, 23 bp, synthetic construct
  source 1..23: mol_type = other DNA
agagcrtttcttgaatccagcgg

SEQ ID NO: 2249 - DNA, 23 bp, synthetic construct
  source 1..23: mol_type = other DNA
ccatccgagaggtgcttygcctc

SEQ ID NO: 2250 - DNA, 23 bp, synthetic construct
  source 1..23: mol_type = other DNA
cccagctcatctcacygtcagta

SEQ ID NO: 2251 - DNA, 23 bp, synthetic construct
  source 1..23: mol_type = other DNA
ccagctcatctcacygtcagtaa

SEQ ID NO: 2252 - DNA, 23 bp, synthetic construct
  source 1..23: mol_type = other DNA
ccaactatcagtgacygtaaccg

SEQ ID NO: 2253 - DNA, 23 bp, synthetic construct
  source 1..23: mol_type = other DNA
atcgraaacgcggcggcggtggg

SEQ ID NO: 2254 - DNA, 23 bp, synthetic construct
  source 1..23: mol_type = other DNA
gatcgraaacgcggcggcggtgg

SEQ ID NO: 2255 - DNA, 23 bp, synthetic construct
  source 1..23: mol_type = other DNA
actgatcgraaacgcggcggcgg

SEQ ID NO: 2256 - DNA, 23 bp, synthetic construct
  source 1..23: mol_type = other DNA
acgggcccrggggcgcggaccgg

SEQ ID NO: 2257 - DNA, 23 bp, synthetic construct
  source 1..23: mol_type = other DNA
cccatacaaggcagayggtccct

SEQ ID NO: 2258 - DNA, 23 bp, synthetic construct
  source 1..23: mol_type = other DNA
ccatacaaggcagayggtccctc

SEQ ID NO: 2259 - DNA, 23 bp, synthetic construct
  source 1..23: mol_type = other DNA
gttctrgcctggtatgtgggggg

SEQ ID NO: 2260 - DNA, 23 bp, synthetic construct
  source 1..23: mol_type = other DNA
agttctrgcctggtatgtggggg

SEQ ID NO: 2261 - DNA, 23 bp, synthetic construct
  source 1..23: mol_type = other DNA
gagttctrgcctggtatgtgggg

SEQ ID NO: 2262 - DNA, 23 bp, synthetic construct
  source 1..23: mol_type = other DNA
tgagttctrgcctggtatgtggg

SEQ ID NO: 2263 - DNA, 23 bp, synthetic construct
  source 1..23: mol_type = other DNA
ccgaggtgctgcgcctgyggccc

SEQ ID NO: 2264 - DNA, 23 bp, synthetic construct
  source 1..23: mol_type = other DNA
ccttcacgctgctgycctccggg

SEQ ID NO: 2265 - DNA, 23 bp, synthetic construct
  source 1..23: mol_type = other DNA
ccggagcctccacctccygcctc

SEQ ID NO: 2266 - DNA, 23 bp, synthetic construct
  source 1..23: mol_type = other DNA
ccagattcagcagcgactgyagg

SEQ ID NO: 2267 - DNA, 23 bp, synthetic construct
  source 1..23: mol_type = other DNA
cacaragctccagctggctgcgg

SEQ ID NO: 2268 - DNA, 23 bp, synthetic construct
  source 1..23: mol_type = other DNA
tccrggcctgcctgggccgcagg

SEQ ID NO: 2269 - DNA, 23 bp, synthetic construct
  source 1..23: mol_type = other DNA
aaactcccrgatcatagaaaagg

SEQ ID NO: 2270 - DNA, 23 bp, synthetic construct
  source 1..23: mol_type = other DNA
cacrtgagctggggcctgaaggg

SEQ ID NO: 2271 - DNA, 23 bp, synthetic construct
  source 1..23: mol_type = other DNA
ccacrtgagctggggcctgaagg

SEQ ID NO: 2272 - DNA, 23 bp, synthetic construct
  source 1..23: mol_type = other DNA
tacrgaacgacatggagctatgg

SEQ ID NO: 2273 - DNA, 23 bp, synthetic construct
  source 1..23: mol_type = other DNA
ccactggtaccagctgcgcyagg

SEQ ID NO: 2274 - DNA, 23 bp, synthetic construct
  source 1..23: mol_type = other DNA
ccatcgggttaatgttcyagaac

SEQ ID NO: 2275 - DNA, 23 bp, synthetic construct
  source 1..23: mol_type = other DNA
ccctttggctatggggtcygggc

SEQ ID NO: 2276 - DNA, 23 bp, synthetic construct
  source 1..23: mol_type = other DNA
cctttggctatggggtcygggcc

SEQ ID NO: 2277 - DNA, 23 bp, synthetic construct
  source 1..23: mol_type = other DNA
cccatttggctctgtgycctttg

SEQ ID NO: 2278 - DNA, 23 bp, synthetic construct
  source 1..23: mol_type = other DNA
ccatttggctctgtgycctttgg

SEQ ID NO: 2279 - DNA, 23 bp, synthetic construct
  source 1..23: mol_type = other DNA
agcrctgcagcttctcgccctgg

SEQ ID NO: 2280 - DNA, 23 bp, synthetic construct
  source 1..23: mol_type = other DNA
ccagacgctggtcaytctgtgtc

SEQ ID NO: 2281 - DNA, 23 bp, synthetic construct
  source 1..23: mol_type = other DNA
ccccgaagtccagacagcaytcc

SEQ ID NO: 2282 - DNA, 23 bp, synthetic construct
  source 1..23: mol_type = other DNA
cccgaagtccagacagcaytcca

SEQ ID NO: 2283 - DNA, 23 bp, synthetic construct
  source 1..23: mol_type = other DNA
ccgaagtccagacagcaytccac

SEQ ID NO: 2284 - DNA, 23 bp, synthetic construct
  source 1..23: mol_type = other DNA
ggtcrggccagtgcccatggtgg

SEQ ID NO: 2285 - DNA, 23 bp, synthetic construct
  source 1..23: mol_type = other DNA
ctgggtcrggccagtgcccatgg

SEQ ID NO: 2286 - DNA, 23 bp, synthetic construct
  source 1..23: mol_type = other DNA
aactgrtccttatacctgttggg

SEQ ID NO: 2287 - DNA, 23 bp, synthetic construct
  source 1..23: mol_type = other DNA
aaactgrtccttatacctgttgg

SEQ ID NO: 2288 - DNA, 23 bp, synthetic construct
  source 1..23: mol_type = other DNA
ttcrtccaagtaatggcatctgg

SEQ ID NO: 2289 - DNA, 23 bp, synthetic construct
  source 1..23: mol_type = other DNA
cctttttccttctgttcytttat

SEQ ID NO: 2290 - DNA, 23 bp, synthetic construct
  source 1..23: mol_type = other DNA
tatgatcrttttatagaagatgg

SEQ ID NO: 2291 - DNA, 23 bp, synthetic construct
  source 1..23: mol_type = other DNA
ccggggactactgtgtgygaaag

SEQ ID NO: 2292 - DNA, 23 bp, synthetic construct
  source 1..23: mol_type = other DNA
cctgtgactgttttgayggtgat

SEQ ID NO: 2293 - DNA, 23 bp, synthetic construct
  source 1..23: mol_type = other DNA
ccttccggggacatgacytcatg

SEQ ID NO: 2294 - DNA, 23 bp, synthetic construct
  source 1..23: mol_type = other DNA
ccttcccaaagtccttcygggga

SEQ ID NO: 2295 - DNA, 23 bp, synthetic construct
  source 1..23: mol_type = other DNA
ctcrtggtgctctggaccgatgg

SEQ ID NO: 2296 - DNA, 23 bp, synthetic construct
  source 1..23: mol_type = other DNA
attccacragcaaatgcaatggg

SEQ ID NO: 2297 - DNA, 23 bp, synthetic construct
  source 1..23: mol_type = other DNA
aattccacragcaaatgcaatgg

SEQ ID NO: 2298 - DNA, 23 bp, synthetic construct
  source 1..23: mol_type = other DNA
atgatrgaactgttcaaggcagg

SEQ ID NO: 2299 - DNA, 23 bp, synthetic construct
  source 1..23: mol_type = other DNA
atgggraccgctacttcaagggg

SEQ ID NO: 2300 - DNA, 23 bp, synthetic construct
  source 1..23: mol_type = other DNA
aatgggraccgctacttcaaggg

SEQ ID NO: 2301 - DNA, 23 bp, synthetic construct
  source 1..23: mol_type = other DNA
caatgggraccgctacttcaagg

SEQ ID NO: 2302 - DNA, 23 bp, synthetic construct
  source 1..23: mol_type = other DNA
aggaargtaatttaaatagtggg

SEQ ID NO: 2303 - DNA, 23 bp, synthetic construct
  source 1..23: mol_type = other DNA
gaggaargtaatttaaatagtgg

SEQ ID NO: 2304 - DNA, 23 bp, synthetic construct
  source 1..23: mol_type = other DNA
atgrggaccgctacttcaagggg

SEQ ID NO: 2305 - DNA, 23 bp, synthetic construct
  source 1..23: mol_type = other DNA
aatgrggaccgctacttcaaggg

SEQ ID NO: 2306 - DNA, 23 bp, synthetic construct
  source 1..23: mol_type = other DNA
caatgrggaccgctacttcaagg

SEQ ID NO: 2307 - DNA, 23 bp, synthetic construct
  source 1..23: mol_type = other DNA
ccaraatgccgagtcatgaaggg

SEQ ID NO: 2308 - DNA, 23 bp, synthetic construct
  source 1..23: mol_type = other DNA
cccaraatgccgagtcatgaagg

SEQ ID NO: 2309 - DNA, 23 bp, synthetic construct
  source 1..23: mol_type = other DNA
ccgcagtggggtgaagcctygga

SEQ ID NO: 2310 - DNA, 23 bp, synthetic construct
  source 1..23: mol_type = other DNA
cccactgtagcttctacygaacc

SEQ ID NO: 2311 - DNA, 23 bp, synthetic construct
  source 1..23: mol_type = other DNA
ccactgtagcttctacygaacca

SEQ ID NO: 2312 - DNA, 23 bp, synthetic construct
  source 1..23: mol_type = other DNA
ccgaaccagaaccttgyaggcac

SEQ ID NO: 2313 - DNA, 23 bp, synthetic construct
  source 1..23: mol_type = other DNA
cctctgaccgttttygcagcttt

SEQ ID NO: 2314 - DNA, 23 bp, synthetic construct
  source 1..23: mol_type = other DNA
cctgcctcagggagtgygttaca

SEQ ID NO: 2315 - DNA, 23 bp, synthetic construct
  source 1..23: mol_type = other DNA
ccaatatgaaagcccccyagtcc

SEQ ID NO: 2316 - DNA, 23 bp, synthetic construct
  source 1..23: mol_type = other DNA
ccttttgccccagaatgcygagt

SEQ ID NO: 2317 - DNA, 23 bp, synthetic construct
  source 1..23: mol_type = other DNA
ccctggtcctatgcgcygaagca

SEQ ID NO: 2318 - DNA, 23 bp, synthetic construct
  source 1..23: mol_type = other DNA
cctggtcctatgcgcygaagcaa

SEQ ID NO: 2319 - DNA, 23 bp, synthetic construct
  source 1..23: mol_type = other DNA
ccagaagagcgagatcygagttt

SEQ ID NO: 2320 - DNA, 23 bp, synthetic construct
  source 1..23: mol_type = other DNA
ccacaacatgctgctyctttgac

SEQ ID NO: 2321 - DNA, 23 bp, synthetic construct
  source 1..23: mol_type = other DNA
ccgggcagtgctccctatcygct

SEQ ID NO: 2322 - DNA, 23 bp, synthetic construct
  source 1..23: mol_type = other DNA
cctccaaagggtgtcygccacac

SEQ ID NO: 2323 - DNA, 23 bp, synthetic construct
  source 1..23: mol_type = other DNA
cccttcaccagttcygctcagga

SEQ ID NO: 2324 - DNA, 23 bp, synthetic construct
  source 1..23: mol_type = other DNA
cccaattttagtggytacagcag

SEQ ID NO: 2325 - DNA, 23 bp, synthetic construct
  source 1..23: mol_type = other DNA
ccccrgccgcctgcaaggaaggg

SEQ ID NO: 2326 - DNA, 23 bp, synthetic construct
  source 1..23: mol_type = other DNA
tccccrgccgcctgcaaggaagg

SEQ ID NO: 2327 - DNA, 23 bp, synthetic construct
  source 1..23: mol_type = other DNA
cctacatggacagcccaygaaag

SEQ ID NO: 2328 - DNA, 23 bp, synthetic construct
  source 1..23: mol_type = other DNA
gggagrtaagtggtctgtctggg

SEQ ID NO: 2329 - DNA, 23 bp, synthetic construct
  source 1..23: mol_type = other DNA
ggggagrtaagtggtctgtctgg

SEQ ID NO: 2330 - DNA, 23 bp, synthetic construct
  source 1..23: mol_type = other DNA
atgtgragattgccacctaccgg

SEQ ID NO: 2331 - DNA, 23 bp, synthetic construct
  source 1..23: mol_type = other DNA
gggagagragagccggtgagggg

SEQ ID NO: 2332 - DNA, 23 bp, synthetic construct
  source 1..23: mol_type = other DNA
agggagagragagccggtgaggg

SEQ ID NO: 2333 - DNA, 23 bp, synthetic construct
  source 1..23: mol_type = other DNA
cccttttaggatcaatctcycca

SEQ ID NO: 2334 - DNA, 23 bp, synthetic construct
  source 1..23: mol_type = other DNA
ccttttaggatcaatctcyccat

SEQ ID NO: 2335 - DNA, 23 bp, synthetic construct
  source 1..23: mol_type = other DNA
ccagccagcgcgtgtcctyctac

SEQ ID NO: 2336 - DNA, 23 bp, synthetic construct
  source 1..23: mol_type = other DNA
ccagcgcgtgtcctyctaccgcc

SEQ ID NO: 2337 - DNA, 23 bp, synthetic construct
  source 1..23: mol_type = other DNA
cctggggaaccagacaygagtgc

SEQ ID NO: 2338 - DNA, 23 bp, synthetic construct
  source 1..23: mol_type = other DNA
cctcagagaggagtgagaaytgg

SEQ ID NO: 2339 - DNA, 23 bp, synthetic construct
  source 1..23: mol_type = other DNA
ccagcgccccaggcygaggaagg

SEQ ID NO: 2340 - DNA, 23 bp, synthetic construct
  source 1..23: mol_type = other DNA
ccttctggtgtagcctcyagcgg

SEQ ID NO: 2341 - DNA, 23 bp, synthetic construct
  source 1..23: mol_type = other DNA
agargtctgtgtacagtgacagg

SEQ ID NO: 2342 - DNA, 23 bp, synthetic construct
  source 1..23: mol_type = other DNA
ggcgccccrggatcgtcgcctgg

SEQ ID NO: 2343 - DNA, 23 bp, synthetic construct
  source 1..23: mol_type = other DNA
ggcrccccgggatcgtcgcctgg

SEQ ID NO: 2344 - DNA, 23 bp, synthetic construct
  source 1..23: mol_type = other DNA
tctacrtgattgacttcttctgg

SEQ ID NO: 2345 - DNA, 23 bp, synthetic construct
  source 1..23: mol_type = other DNA
ccaagactccacctataaygagg

SEQ ID NO: 2346 - DNA, 23 bp, synthetic construct
  source 1..23: mol_type = other DNA
cctactgctgttcgccyccttca

SEQ ID NO: 2347 - DNA, 23 bp, synthetic construct
  source 1..23: mol_type = other DNA
cagtcacrggctttcagtggtgg

SEQ ID NO: 2348 - DNA, 23 bp, synthetic construct
  source 1..23: mol_type = other DNA
ccctagacccagagtcttcygcc

SEQ ID NO: 2349 - DNA, 23 bp, synthetic construct
  source 1..23: mol_type = other DNA
cctagacccagagtcttcygcct

SEQ ID NO: 2350 - DNA, 23 bp, synthetic construct
  source 1..23: mol_type = other DNA
aagacartgcagtaagttccggg

SEQ ID NO: 2351 - DNA, 23 bp, synthetic construct
  source 1..23: mol_type = other DNA
aaagacartgcagtaagttccgg

SEQ ID NO: 2352 - DNA, 23 bp, synthetic construct
  source 1..23: mol_type = other DNA
cccacagacagcacacytgccac

SEQ ID NO: 2353 - DNA, 23 bp, synthetic construct
  source 1..23: mol_type = other DNA
ccacagacagcacacytgccacc

SEQ ID NO: 2354 - DNA, 23 bp, synthetic construct
  source 1..23: mol_type = other DNA
tgtgttraaggaatggctggtgg

SEQ ID NO: 2355 - DNA, 23 bp, synthetic construct
  source 1..23: mol_type = other DNA
gaatrtccccccaacttcaccgg

SEQ ID NO: 2356 - DNA, 23 bp, synthetic construct
  source 1..23: mol_type = other DNA
gctttgrtgggaagaagtagagg

SEQ ID NO: 2357 - DNA, 23 bp, synthetic construct
  source 1..23: mol_type = other DNA
tttgraatataatcctccactgg

SEQ ID NO: 2358 - DNA, 23 bp, synthetic construct
  source 1..23: mol_type = other DNA
gaargtctatgccagaaaggagg

SEQ ID NO: 2359 - DNA, 23 bp, synthetic construct
  source 1..23: mol_type = other DNA
gtggaargtctatgccagaaagg

SEQ ID NO: 2360 - DNA, 23 bp, synthetic construct
  source 1..23: mol_type = other DNA
cctgaagrttggtaaatttctgg

SEQ ID NO: 2361 - DNA, 23 bp, synthetic construct
  source 1..23: mol_type = other DNA
agcccagargtaattgaatgtgg

SEQ ID NO: 2362 - DNA, 23 bp, synthetic construct
  source 1..23: mol_type = other DNA
ataatargggacgaacagggagg

SEQ ID NO: 2363 - DNA, 23 bp, synthetic construct
  source 1..23: mol_type = other DNA
cctcttcagtgacctayaggatg

SEQ ID NO: 2364 - DNA, 23 bp, synthetic construct
  source 1..23: mol_type = other DNA
cctcgaaggcctgacagggyaaa

SEQ ID NO: 2365 - DNA, 23 bp, synthetic construct
  source 1..23: mol_type = other DNA
ccaagttttgcctcaayaagtga

SEQ ID NO: 2366 - DNA, 23 bp, synthetic construct
  source 1..23: mol_type = other DNA
ccagctggttgagcattgtyaaa

SEQ ID NO: 2367 - DNA, 23 bp, synthetic construct
  source 1..23: mol_type = other DNA
ccaggtattgggagatygatggg

SEQ ID NO: 2368 - DNA, 23 bp, synthetic construct
  source 1..23: mol_type = other DNA
ccggctatcagatcttyaacctc

SEQ ID NO: 2369 - DNA, 23 bp, synthetic construct
  source 1..23: mol_type = other DNA
ccatcaggacatgggtcyagcag

SEQ ID NO: 2370 - DNA, 23 bp, synthetic construct
  source 1..23: mol_type = other DNA
ccagccaattttgagyagcgtct

SEQ ID NO: 2371 - DNA, 23 bp, synthetic construct
  source 1..23: mol_type = other DNA
cctttgaaggaattggagyagtt

SEQ ID NO: 2372 - DNA, 23 bp, synthetic construct
  source 1..23: mol_type = other DNA
ccagcagtcagccacacaaygac

SEQ ID NO: 2373 - DNA, 23 bp, synthetic construct
  source 1..23: mol_type = other DNA
ccaaagacctccgcyagtggcag

SEQ ID NO: 2374 - DNA, 23 bp, synthetic construct
  source 1..23: mol_type = other DNA
cctttgtgacctttggyaagtca

SEQ ID NO: 2375 - DNA, 23 bp, synthetic construct
  source 1..23: mol_type = other DNA
ccaatttgtacatcygaactgga

SEQ ID NO: 2376 - DNA, 23 bp, synthetic construct
  source 1..23: mol_type = other DNA
ccacgctttttgtgygacatcca

SEQ ID NO: 2377 - DNA, 23 bp, synthetic construct
  source 1..23: mol_type = other DNA
gacagrtaggtggagtggtgagg

SEQ ID NO: 2378 - DNA, 23 bp, synthetic construct
  source 1..23: mol_type = other DNA
ccccactcctctcccyagaaccg

SEQ ID NO: 2379 - DNA, 23 bp, synthetic construct
  source 1..23: mol_type = other DNA
cccactcctctcccyagaaccga

SEQ ID NO: 2380 - DNA, 23 bp, synthetic construct
  source 1..23: mol_type = other DNA
cgagcrgttcccatttgagctgg

SEQ ID NO: 2381 - DNA, 23 bp, synthetic construct
  source 1..23: mol_type = other DNA
ccaaggccgtggaggtgyagaac

SEQ ID NO: 2382 - DNA, 23 bp, synthetic construct
  source 1..23: mol_type = other DNA
cgtcrcttctgaagtgtgtgagg

SEQ ID NO: 2383 - DNA, 23 bp, synthetic construct
  source 1..23: mol_type = other DNA
tccrgtacccccaggatctttgg

SEQ ID NO: 2384 - DNA, 23 bp, synthetic construct
  source 1..23: mol_type = other DNA
ccctgaggctgagctcyggaaag

SEQ ID NO: 2385 - DNA, 23 bp, synthetic construct
  source 1..23: mol_type = other DNA
cctgaggctgagctcyggaaagc

SEQ ID NO: 2386 - DNA, 23 bp, synthetic construct
  source 1..23: mol_type = other DNA
ccactcragcctttatctgaggg

SEQ ID NO: 2387 - DNA, 23 bp, synthetic construct
  source 1..23: mol_type = other DNA
gccactcragcctttatctgagg

SEQ ID NO: 2388 - DNA, 23 bp, synthetic construct
  source 1..23: mol_type = other DNA
tgarcagcggcacacgggtccgg

SEQ ID NO: 2389 - DNA, 23 bp, synthetic construct
  source 1..23: mol_type = other DNA
agatgtgarcagcggcacacggg

SEQ ID NO: 2390 - DNA, 23 bp, synthetic construct
  source 1..23: mol_type = other DNA
ccttcaagattataagayaagaa

SEQ ID NO: 2391 - DNA, 23 bp, synthetic construct
  source 1..23: mol_type = other DNA
gtgttcratgcagatgaaatagg

SEQ ID NO: 2392 - DNA, 23 bp, synthetic construct
  source 1..23: mol_type = other DNA
tagtgcrgcaaaagcgcgcctgg

SEQ ID NO: 2393 - DNA, 23 bp, synthetic construct
  source 1..23: mol_type = other DNA
gcccccrtggctcttcgggaggg

SEQ ID NO: 2394 - DNA, 23 bp, synthetic construct
  source 1..23: mol_type = other DNA
cgcccccrtggctcttcgggagg

SEQ ID NO: 2395 - DNA, 23 bp, synthetic construct
  source 1..23: mol_type = other DNA
cattgcrgaaagggcgccaaagg

SEQ ID NO: 2396 - DNA, 23 bp, synthetic construct
  source 1..23: mol_type = other DNA
cctgtaaaacaagctyaagttca

SEQ ID NO: 2397 - DNA, 23 bp, synthetic construct
  source 1..23: mol_type = other DNA
gagrtgaccagcggcggcggggg

SEQ ID NO: 2398 - DNA, 23 bp, synthetic construct
  source 1..23: mol_type = other DNA
cgagrtgaccagcggcggcgggg

SEQ ID NO: 2399 - DNA, 23 bp, synthetic construct
  source 1..23: mol_type = other DNA
acgagrtgaccagcggcggcggg

SEQ ID NO: 2400 - DNA, 23 bp, synthetic construct
  source 1..23: mol_type = other DNA
tacgagrtgaccagcggcggcgg

SEQ ID NO: 2401 - DNA, 23 bp, synthetic construct
  source 1..23: mol_type = other DNA
ctcrctccggatctcgctccggg

SEQ ID NO: 2402 - DNA, 23 bp, synthetic construct
  source 1..23: mol_type = other DNA
tctcrctccggatctcgctccgg

SEQ ID NO: 2403 - DNA, 23 bp, synthetic construct
  source 1..23: mol_type = other DNA
ccatcagtgtccctygagtccgc

SEQ ID NO: 2404 - DNA, 23 bp, synthetic construct
  source 1..23: mol_type = other DNA
ccactgagcagcgaaggygagct

SEQ ID NO: 2405 - DNA, 23 bp, synthetic construct
  source 1..23: mol_type = other DNA
aatcrggcttccctggcttgcgg

SEQ ID NO: 2406 - DNA, 23 bp, synthetic construct
  source 1..23: mol_type = other DNA
tgaaraggatgctctcagctggg

SEQ ID NO: 2407 - DNA, 23 bp, synthetic construct
  source 1..23: mol_type = other DNA
ttgaaraggatgctctcagctgg

SEQ ID NO: 2408 - DNA, 23 bp, synthetic construct
  source 1..23: mol_type = other DNA
tagrtgccaaagatgtacaatgg

SEQ ID NO: 2409 - DNA, 23 bp, synthetic construct
  source 1..23: mol_type = other DNA
cactgcrcacgatgtagtcatgg

SEQ ID NO: 2410 - DNA, 23 bp, synthetic construct
  source 1..23: mol_type = other DNA
ctgrggtaacgtgaaacctgtgg

SEQ ID NO: 2411 - DNA, 23 bp, synthetic construct
  source 1..23: mol_type = other DNA
cccrtgagttctcaccactttgg

SEQ ID NO: 2412 - DNA, 23 bp, synthetic construct
  source 1..23: mol_type = other DNA
gtgtgtacrtggatgggggctgg

SEQ ID NO: 2413 - DNA, 23 bp, synthetic construct
  source 1..23: mol_type = other DNA
gcctrtgagtacatttccctggg

SEQ ID NO: 2414 - DNA, 23 bp, synthetic construct
  source 1..23: mol_type = other DNA
cgcctrtgagtacatttccctgg

SEQ ID NO: 2415 - DNA, 23 bp, synthetic construct
  source 1..23: mol_type = other DNA
tgagcracatttatgtgaaaggg

SEQ ID NO: 2416 - DNA, 23 bp, synthetic construct
  source 1..23: mol_type = other DNA
atgagcracatttatgtgaaagg

SEQ ID NO: 2417 - DNA, 23 bp, synthetic construct
  source 1..23: mol_type = other DNA
ccaaggtcccactcygagaggtc

SEQ ID NO: 2418 - DNA, 23 bp, synthetic construct
  source 1..23: mol_type = other DNA
cctcttttgagctcatcyagaga

SEQ ID NO: 2419 - DNA, 23 bp, synthetic construct
  source 1..23: mol_type = other DNA
ccctgcagctctggagyaggcgg

SEQ ID NO: 2420 - DNA, 23 bp, synthetic construct
  source 1..23: mol_type = other DNA
cctgcagctctggagyaggcgga

SEQ ID NO: 2421 - DNA, 23 bp, synthetic construct
  source 1..23: mol_type = other DNA
ccgtatctacattgtcygagcat

SEQ ID NO: 2422 - DNA, 23 bp, synthetic construct
  source 1..23: mol_type = other DNA
tcggtrcaggaacatgagccagg

SEQ ID NO: 2423 - DNA, 23 bp, synthetic construct
  source 1..23: mol_type = other DNA
ccccrgcgggggctctcatcagg

SEQ ID NO: 2424 - DNA, 23 bp, synthetic construct
  source 1..23: mol_type = other DNA
tgtrgggaccactcagcctgtgg

SEQ ID NO: 2425 - DNA, 23 bp, synthetic construct
  source 1..23: mol_type = other DNA
gccctgtrgctggtgctgcctgg

SEQ ID NO: 2426 - DNA, 23 bp, synthetic construct
  source 1..23: mol_type = other DNA
cccacctgrcatatactggctgg

SEQ ID NO: 2427 - DNA, 23 bp, synthetic construct
  source 1..23: mol_type = other DNA
cccattggggacttggcggygac

SEQ ID NO: 2428 - DNA, 23 bp, synthetic construct
  source 1..23: mol_type = other DNA
ccattggggacttggcggygact

SEQ ID NO: 2429 - DNA, 23 bp, synthetic construct
  source 1..23: mol_type = other DNA
ccaagggagacagcygatacatc

SEQ ID NO: 2430 - DNA, 23 bp, synthetic construct
  source 1..23: mol_type = other DNA
ccagagagccatggycgccctgc

SEQ ID NO: 2431 - DNA, 23 bp, synthetic construct
  source 1..23: mol_type = other DNA
ccagctggagagggagttcyagc

SEQ ID NO: 2432 - DNA, 23 bp, synthetic construct
  source 1..23: mol_type = other DNA
cccctccccacccctatccygaa

SEQ ID NO: 2433 - DNA, 23 bp, synthetic construct
  source 1..23: mol_type = other DNA
ccctccccacccctatccygaag

SEQ ID NO: 2434 - DNA, 23 bp, synthetic construct
  source 1..23: mol_type = other DNA
cctccccacccctatccygaagc

SEQ ID NO: 2435 - DNA, 23 bp, synthetic construct
  source 1..23: mol_type = other DNA
ccccacccctatccygaagcctc

SEQ ID NO: 2436 - DNA, 23 bp, synthetic construct
  source 1..23: mol_type = other DNA
cagcrgggagctggaggtactgg

SEQ ID NO: 2437 - DNA, 23 bp, synthetic construct
  source 1..23: mol_type = other DNA
ccagrtgagtcacctagtagggg

SEQ ID NO: 2438 - DNA, 23 bp, synthetic construct
  source 1..23: mol_type = other DNA
accagrtgagtcacctagtaggg

SEQ ID NO: 2439 - DNA, 23 bp, synthetic construct
  source 1..23: mol_type = other DNA
caccagrtgagtcacctagtagg

SEQ ID NO: 2440 - DNA, 23 bp, synthetic construct
  source 1..23: mol_type = other DNA
ccgcgggagcgagggagcyaggg

SEQ ID NO: 2441 - DNA, 23 bp, synthetic construct
  source 1..23: mol_type = other DNA
ccagggattcctggaattcyagg

SEQ ID NO: 2442 - DNA, 23 bp, synthetic construct
  source 1..23: mol_type = other DNA
ccaggtcctcctggtcctyaagg

SEQ ID NO: 2443 - DNA, 23 bp, synthetic construct
  source 1..23: mol_type = other DNA
aggcrtcacaaagactgtgaggg

SEQ ID NO: 2444 - DNA, 23 bp, synthetic construct
  source 1..23: mol_type = other DNA
caggcrtcacaaagactgtgagg

SEQ ID NO: 2445 - DNA, 23 bp, synthetic construct
  source 1..23: mol_type = other DNA
gattgagcrgctggatgctgtgg

SEQ ID NO: 2446 - DNA, 23 bp, synthetic construct
  source 1..23: mol_type = other DNA
cctcgagaagactagcygaatgc

SEQ ID NO: 2447 - DNA, 23 bp, synthetic construct
  source 1..23: mol_type = other DNA
ctatgacraattgtgcttcctgg

SEQ ID NO: 2448 - DNA, 23 bp, synthetic construct
  source 1..23: mol_type = other DNA
ccacaaatgaatgcygggaggat

SEQ ID NO: 2449 - DNA, 23 bp, synthetic construct
  source 1..23: mol_type = other DNA
ttctcctrccactgcccacaggg

SEQ ID NO: 2450 - DNA, 23 bp, synthetic construct
  source 1..23: mol_type = other DNA
tttctcctrccactgcccacagg

SEQ ID NO: 2451 - DNA, 23 bp, synthetic construct
  source 1..23: mol_type = other DNA
ccagctgctggccacaygcctct

SEQ ID NO: 2452 - DNA, 23 bp, synthetic construct
  source 1..23: mol_type = other DNA
ccgccccttggagccayagccag

SEQ ID NO: 2453 - DNA, 23 bp, synthetic construct
  source 1..23: mol_type = other DNA
ccgctctgacgagctgacayggc

SEQ ID NO: 2454 - DNA, 23 bp, synthetic construct
  source 1..23: mol_type = other DNA
ccgcgcaagttagatygatttca

SEQ ID NO: 2455 - DNA, 23 bp, synthetic construct
  source 1..23: mol_type = other DNA
cctcaaagaggctgccygaaaga

SEQ ID NO: 2456 - DNA, 23 bp, synthetic construct
  source 1..23: mol_type = other DNA
gcggtttcrggtggtagtggtgg

SEQ ID NO: 2457 - DNA, 23 bp, synthetic construct
  source 1..23: mol_type = other DNA
agagrtaagtacagaggaaaagg

SEQ ID NO: 2458 - DNA, 23 bp, synthetic construct
  source 1..23: mol_type = other DNA
ccaatgcccggtgtattgycctg

SEQ ID NO: 2459 - DNA, 23 bp, synthetic construct
  source 1..23: mol_type = other DNA
cccccagccacccaactygttgc

SEQ ID NO: 2460 - DNA, 23 bp, synthetic construct
  source 1..23: mol_type = other DNA
ccccagccacccaactygttgcc

SEQ ID NO: 2461 - DNA, 23 bp, synthetic construct
  source 1..23: mol_type = other DNA
cccagccacccaactygttgcca

SEQ ID NO: 2462 - DNA, 23 bp, synthetic construct
  source 1..23: mol_type = other DNA
ccagccacccaactygttgccac

SEQ ID NO: 2463 - DNA, 23 bp, synthetic construct
  source 1..23: mol_type = other DNA
ggaggagcrcagggagaagcggg

SEQ ID NO: 2464 - DNA, 23 bp, synthetic construct
  source 1..23: mol_type = other DNA
ccgccacagctcaacgggtyggc

SEQ ID NO: 2465 - DNA, 23 bp, synthetic construct
  source 1..23: mol_type = other DNA
ccacagctcaacgggtyggccac

SEQ ID NO: 2466 - DNA, 23 bp, synthetic construct
  source 1..23: mol_type = other DNA
gtttgrtgagcactgggtggagg

SEQ ID NO: 2467 - DNA, 23 bp, synthetic construct
  source 1..23: mol_type = other DNA
ccagtttgrtgagcactgggtgg

SEQ ID NO: 2468 - DNA, 23 bp, synthetic construct
  source 1..23: mol_type = other DNA
ccttgtagccgaagctyaggcag

SEQ ID NO: 2469 - DNA, 23 bp, synthetic construct
  source 1..23: mol_type = other DNA
ccacgcrggcagggattcccagg

SEQ ID NO: 2470 - DNA, 23 bp, synthetic construct
  source 1..23: mol_type = other DNA
tgccaaatrtttggtgatgaagg

SEQ ID NO: 2471 - DNA, 23 bp, synthetic construct
  source 1..23: mol_type = other DNA
ccagctgcgatgcccygcagcat

SEQ ID NO: 2472 - DNA, 23 bp, synthetic construct
  source 1..23: mol_type = other DNA
gtggragctgatgacttttgggg

SEQ ID NO: 2473 - DNA, 23 bp, synthetic construct
  source 1..23: mol_type = other DNA
tgtggragctgatgacttttggg

SEQ ID NO: 2474 - DNA, 23 bp, synthetic construct
  source 1..23: mol_type = other DNA
gtgtggragctgatgacttttgg

SEQ ID NO: 2475 - DNA, 23 bp, synthetic construct
  source 1..23: mol_type = other DNA
gccracaaggtgcagcttcaggg

SEQ ID NO: 2476 - DNA, 23 bp, synthetic construct
  source 1..23: mol_type = other DNA
tgccracaaggtgcagcttcagg

SEQ ID NO: 2477 - DNA, 23 bp, synthetic construct
  source 1..23: mol_type = other DNA
cctgcgcttctgcccacagyggt

SEQ ID NO: 2478 - DNA, 23 bp, synthetic construct
  source 1..23: mol_type = other DNA
cctgcggcagatggcayagccct

SEQ ID NO: 2479 - DNA, 23 bp, synthetic construct
  source 1..23: mol_type = other DNA
ccttcgatgccatgygccacgcg

SEQ ID NO: 2480 - DNA, 23 bp, synthetic construct
  source 1..23: mol_type = other DNA
ccagtgcaccactacgggygggc

SEQ ID NO: 2481 - DNA, 23 bp, synthetic construct
  source 1..23: mol_type = other DNA
ccaagtacttcctgyggcagatg

SEQ ID NO: 2482 - DNA, 23 bp, synthetic construct
  source 1..23: mol_type = other DNA
cctgggaggccgagygagtcatg

SEQ ID NO: 2483 - DNA, 23 bp, synthetic construct
  source 1..23: mol_type = other DNA
ccgatgcaaaataacctcygaga

SEQ ID NO: 2484 - DNA, 23 bp, synthetic construct
  source 1..23: mol_type = other DNA
ccaagcactgtttggtagyaggt

SEQ ID NO: 2485 - DNA, 23 bp, synthetic construct
  source 1..23: mol_type = other DNA
tgagcctcrgcccaggcggcggg

SEQ ID NO: 2486 - DNA, 23 bp, synthetic construct
  source 1..23: mol_type = other DNA
tctrtggtggcgggggcggtggg

SEQ ID NO: 2487 - DNA, 23 bp, synthetic construct
  source 1..23: mol_type = other DNA
atctrtggtggcgggggcggtgg

SEQ ID NO: 2488 - DNA, 23 bp, synthetic construct
  source 1..23: mol_type = other DNA
ttgatctrtggtggcgggggcgg

SEQ ID NO: 2489 - DNA, 23 bp, synthetic construct
  source 1..23: mol_type = other DNA
gcccrggacggtacccaaggagg

SEQ ID NO: 2490 - DNA, 23 bp, synthetic construct
  source 1..23: mol_type = other DNA
ctggcccrggacggtacccaagg

SEQ ID NO: 2491 - DNA, 23 bp, synthetic construct
  source 1..23: mol_type = other DNA
tcttrgtttttaaaatcattagg

SEQ ID NO: 2492 - DNA, 23 bp, synthetic construct
  source 1..23: mol_type = other DNA
ccaaaaaataaaaccayaagtta

SEQ ID NO: 2493 - DNA, 23 bp, synthetic construct
  source 1..23: mol_type = other DNA
ggcrgaaggtgggtggggcgggg

SEQ ID NO: 2494 - DNA, 23 bp, synthetic construct
  source 1..23: mol_type = other DNA
aggcrgaaggtgggtggggcggg

SEQ ID NO: 2495 - DNA, 23 bp, synthetic construct
  source 1..23: mol_type = other DNA
gaggcrgaaggtgggtggggcgg

SEQ ID NO: 2496 - DNA, 23 bp, synthetic construct
  source 1..23: mol_type = other DNA
gcagaggcrgaaggtgggtgggg

SEQ ID NO: 2497 - DNA, 23 bp, synthetic construct
  source 1..23: mol_type = other DNA
ccaaattcagataatygacgcca

SEQ ID NO: 2498 - DNA, 23 bp, synthetic construct
  source 1..23: mol_type = other DNA
ctgccttcrgaaaggtgagaagg

SEQ ID NO: 2499 - DNA, 23 bp, synthetic construct
  source 1..23: mol_type = other DNA
gtggagcrggagatcgatggggg

SEQ ID NO: 2500 - DNA, 23 bp, synthetic construct
  source 1..23: mol_type = other DNA
agtggagcrggagatcgatgggg

SEQ ID NO: 2501 - DNA, 23 bp, synthetic construct
  source 1..23: mol_type = other DNA
aactgrgtggtacctgaaggtgg

SEQ ID NO: 2502 - DNA, 23 bp, synthetic construct
  source 1..23: mol_type = other DNA
attaactgrgtggtacctgaagg

SEQ ID NO: 2503 - DNA, 23 bp, synthetic construct
  source 1..23: mol_type = other DNA
ttccrgatagtggatcccaacgg

SEQ ID NO: 2504 - DNA, 23 bp, synthetic construct
  source 1..23: mol_type = other DNA
ccgccgcctctcccyggctgaga

SEQ ID NO: 2505 - DNA, 23 bp, synthetic construct
  source 1..23: mol_type = other DNA
gtgtacggrgcggtgtggactgg

SEQ ID NO: 2506 - DNA, 23 bp, synthetic construct
  source 1..23: mol_type = other DNA
cctgaggrccacccaaatgctgg

SEQ ID NO: 2507 - DNA, 23 bp, synthetic construct
  source 1..23: mol_type = other DNA
ccttgtccactgggacttygact

SEQ ID NO: 2508 - DNA, 23 bp, synthetic construct
  source 1..23: mol_type = other DNA
catctgacrtggcaggctggggg

SEQ ID NO: 2509 - DNA, 23 bp, synthetic construct
  source 1..23: mol_type = other DNA
ccacraggaacagaactctgtgg

SEQ ID NO: 2510 - DNA, 23 bp, synthetic construct
  source 1..23: mol_type = other DNA
cagccrtgtggggtctgcaatgg

SEQ ID NO: 2511 - DNA, 23 bp, synthetic construct
  source 1..23: mol_type = other DNA
ccctatggcgtacttygaaccag

SEQ ID NO: 2512 - DNA, 23 bp, synthetic construct
  source 1..23: mol_type = other DNA
cctatggcgtacttygaaccagt

SEQ ID NO: 2513 - DNA, 23 bp, synthetic construct
  source 1..23: mol_type = other DNA
ccctgggtctctgggcatyggaa

SEQ ID NO: 2514 - DNA, 23 bp, synthetic construct
  source 1..23: mol_type = other DNA
cctgggtctctgggcatyggaag

SEQ ID NO: 2515 - DNA, 23 bp, synthetic construct
  source 1..23: mol_type = other DNA
cctttaaaagaaaccctgygaaa

SEQ ID NO: 2516 - DNA, 23 bp, synthetic construct
  source 1..23: mol_type = other DNA
tcccrcaccaggtacagaactgg

SEQ ID NO: 2517 - DNA, 23 bp, synthetic construct
  source 1..23: mol_type = other DNA
gttcragaagaagtcgctggagg

SEQ ID NO: 2518 - DNA, 23 bp, synthetic construct
  source 1..23: mol_type = other DNA
tctgttcragaagaagtcgctgg

SEQ ID NO: 2519 - DNA, 23 bp, synthetic construct
  source 1..23: mol_type = other DNA
caaaaccraaagagagctcctgg

SEQ ID NO: 2520 - DNA, 23 bp, synthetic construct
  source 1..23: mol_type = other DNA
ttggaraaaaccagagagcaggg

SEQ ID NO: 2521 - DNA, 23 bp, synthetic construct
  source 1..23: mol_type = other DNA
gttggaraaaaccagagagcagg

SEQ ID NO: 2522 - DNA, 23 bp, synthetic construct
  source 1..23: mol_type = other DNA
ccgtggcgccacggycctggagc

SEQ ID NO: 2523 - DNA, 23 bp, synthetic construct
  source 1..23: mol_type = other DNA
gtgragaggctctgggattatgg

SEQ ID NO: 2524 - DNA, 23 bp, synthetic construct
  source 1..23: mol_type = other DNA
actcttcrcatggagttgatggg

SEQ ID NO: 2525 - DNA, 23 bp, synthetic construct
  source 1..23: mol_type = other DNA
cactcttcrcatggagttgatgg

SEQ ID NO: 2526 - DNA, 23 bp, synthetic construct
  source 1..23: mol_type = other DNA
tctttgatragaccaaaagctgg

SEQ ID NO: 2527 - DNA, 23 bp, synthetic construct
  source 1..23: mol_type = other DNA
ccctccaattattgctygataca

SEQ ID NO: 2528 - DNA, 23 bp, synthetic construct
  source 1..23: mol_type = other DNA
cctccaattattgctygatacat

SEQ ID NO: 2529 - DNA, 23 bp, synthetic construct
  source 1..23: mol_type = other DNA
ccttcctttatccaaattygctc

SEQ ID NO: 2530 - DNA, 23 bp, synthetic construct
  source 1..23: mol_type = other DNA
cctttatccaaattygctcagtt

SEQ ID NO: 2531 - DNA, 23 bp, synthetic construct
  source 1..23: mol_type = other DNA
ccagaggaaccccaactaygaat

SEQ ID NO: 2532 - DNA, 23 bp, synthetic construct
  source 1..23: mol_type = other DNA
cctgaaagagaatggtycaatgg

SEQ ID NO: 2533 - DNA, 23 bp, synthetic construct
  source 1..23: mol_type = other DNA
cctcgaaggtcacayatttcttg

SEQ ID NO: 2534 - DNA, 23 bp, synthetic construct
  source 1..23: mol_type = other DNA
ccaactaaatcagatcctyggtg

SEQ ID NO: 2535 - DNA, 23 bp, synthetic construct
  source 1..23: mol_type = other DNA
cctcacagagaatatacaaygct

SEQ ID NO: 2536 - DNA, 23 bp, synthetic construct
  source 1..23: mol_type = other DNA
ccacaactcagactttyggaaca

SEQ ID NO: 2537 - DNA, 23 bp, synthetic construct
  source 1..23: mol_type = other DNA
ccttctattctagcyttatttct

SEQ ID NO: 2538 - DNA, 23 bp, synthetic construct
  source 1..23: mol_type = other DNA
ccaaagctggaatttggygggtg

SEQ ID NO: 2539 - DNA, 23 bp, synthetic construct
  source 1..23: mol_type = other DNA
ccaaggagcccttttyttggatc

SEQ ID NO: 2540 - DNA, 23 bp, synthetic construct
  source 1..23: mol_type = other DNA
ccgtttgcacccaaytcattata

SEQ ID NO: 2541 - DNA, 23 bp, synthetic construct
  source 1..23: mol_type = other DNA
cccaactcattatagcattygca

SEQ ID NO: 2542 - DNA, 23 bp, synthetic construct
  source 1..23: mol_type = other DNA
ccaactcattatagcattygcag

SEQ ID NO: 2543 - DNA, 23 bp, synthetic construct
  source 1..23: mol_type = other DNA
cccaccgttactgactygctacc

SEQ ID NO: 2544 - DNA, 23 bp, synthetic construct
  source 1..23: mol_type = other DNA
ccaccgttactgactygctacct

SEQ ID NO: 2545 - DNA, 23 bp, synthetic construct
  source 1..23: mol_type = other DNA
tggrgaagagtcttccacaaagg

SEQ ID NO: 2546 - DNA, 23 bp, synthetic construct
  source 1..23: mol_type = other DNA
caaatatrgaatatataccaagg

SEQ ID NO: 2547 - DNA, 23 bp, synthetic construct
  source 1..23: mol_type = other DNA
gggraagagtcttccacaaaggg

SEQ ID NO: 2548 - DNA, 23 bp, synthetic construct
  source 1..23: mol_type = other DNA
tgggraagagtcttccacaaagg

SEQ ID NO: 2549 - DNA, 23 bp, synthetic construct
  source 1..23: mol_type = other DNA
cctgtactgagggatatygactt

SEQ ID NO: 2550 - DNA, 23 bp, synthetic construct
  source 1..23: mol_type = other DNA
ccggtgaccaggcccatcygcct

SEQ ID NO: 2551 - DNA, 23 bp, synthetic construct
  source 1..23: mol_type = other DNA
tgartatctggctgcactgaggg

SEQ ID NO: 2552 - DNA, 23 bp, synthetic construct
  source 1..23: mol_type = other DNA
gtgartatctggctgcactgagg

SEQ ID NO: 2553 - DNA, 23 bp, synthetic construct
  source 1..23: mol_type = other DNA
actcrtagtatcattgagtttgg

SEQ ID NO: 2554 - DNA, 23 bp, synthetic construct
  source 1..23: mol_type = other DNA
gaartttcctatcagaggtttgg

SEQ ID NO: 2555 - DNA, 23 bp, synthetic construct
  source 1..23: mol_type = other DNA
ccaaagaartttcctatcagagg

SEQ ID NO: 2556 - DNA, 23 bp, synthetic construct
  source 1..23: mol_type = other DNA
ccctgttgcaggtgcayagttgt

SEQ ID NO: 2557 - DNA, 23 bp, synthetic construct
  source 1..23: mol_type = other DNA
cctgttgcaggtgcayagttgtg

SEQ ID NO: 2558 - DNA, 23 bp, synthetic construct
  source 1..23: mol_type = other DNA
cctggaggccctggaccggyggc

SEQ ID NO: 2559 - DNA, 23 bp, synthetic construct
  source 1..23: mol_type = other DNA
ccccttctccttccctaaaygag

SEQ ID NO: 2560 - DNA, 23 bp, synthetic construct
  source 1..23: mol_type = other DNA
cccttctccttccctaaaygagc

SEQ ID NO: 2561 - DNA, 23 bp, synthetic construct
  source 1..23: mol_type = other DNA
ccttctccttccctaaaygagcg

SEQ ID NO: 2562 - DNA, 23 bp, synthetic construct
  source 1..23: mol_type = other DNA
cctgaaccccctggtcyagcgca

SEQ ID NO: 2563 - DNA, 23 bp, synthetic construct
  source 1..23: mol_type = other DNA
ccgtgaccagctctaccagyagc

SEQ ID NO: 2564 - DNA, 23 bp, synthetic construct
  source 1..23: mol_type = other DNA
ccacagaattctggayaatcaaa

SEQ ID NO: 2565 - DNA, 23 bp, synthetic construct
  source 1..23: mol_type = other DNA
ccctgggggaattgctgygaagg

SEQ ID NO: 2566 - DNA, 23 bp, synthetic construct
  source 1..23: mol_type = other DNA
cctgggggaattgctgygaaggg

SEQ ID NO: 2567 - DNA, 23 bp, synthetic construct
  source 1..23: mol_type = other DNA
tcacragacttcaagatcaaagg

SEQ ID NO: 2568 - DNA, 23 bp, synthetic construct
  source 1..23: mol_type = other DNA
ccaagacacagcagaayagaaag

SEQ ID NO: 2569 - DNA, 23 bp, synthetic construct
  source 1..23: mol_type = other DNA
attcctraggatgcaccaactgg

SEQ ID NO: 2570 - DNA, 23 bp, synthetic construct
  source 1..23: mol_type = other DNA
gaggatrgaaggtcttgccaagg

SEQ ID NO: 2571 - DNA, 23 bp, synthetic construct
  source 1..23: mol_type = other DNA
ccctttaccatcttgtacyggga

SEQ ID NO: 2572 - DNA, 23 bp, synthetic construct
  source 1..23: mol_type = other DNA
cctttaccatcttgtacygggac

SEQ ID NO: 2573 - DNA, 23 bp, synthetic construct
  source 1..23: mol_type = other DNA
taccagtgraaccagtgtgttgg

SEQ ID NO: 2574 - DNA, 23 bp, synthetic construct
  source 1..23: mol_type = other DNA
accggtrtgagtgcaacaaaggg

SEQ ID NO: 2575 - DNA, 23 bp, synthetic construct
  source 1..23: mol_type = other DNA
taccggtrtgagtgcaacaaagg

SEQ ID NO: 2576 - DNA, 23 bp, synthetic construct
  source 1..23: mol_type = other DNA
agaatrccgaggtatggtcctgg

SEQ ID NO: 2577 - DNA, 23 bp, synthetic construct
  source 1..23: mol_type = other DNA
cctrtgggaatggaacttgccgg

SEQ ID NO: 2578 - DNA, 23 bp, synthetic construct
  source 1..23: mol_type = other DNA
atgaatrtgcaagtggaaatggg

SEQ ID NO: 2579 - DNA, 23 bp, synthetic construct
  source 1..23: mol_type = other DNA
gatgaatrtgcaagtggaaatgg

SEQ ID NO: 2580 - DNA, 23 bp, synthetic construct
  source 1..23: mol_type = other DNA
tgtargtaagaggatccctgtgg

SEQ ID NO: 2581 - DNA, 23 bp, synthetic construct
  source 1..23: mol_type = other DNA
tacaratatcgatgaatgcaagg

SEQ ID NO: 2582 - DNA, 23 bp, synthetic construct
  source 1..23: mol_type = other DNA
gtacrtgatccatcctaggttgg

SEQ ID NO: 2583 - DNA, 23 bp, synthetic construct
  source 1..23: mol_type = other DNA
attggtacrtgatccatcctagg

SEQ ID NO: 2584 - DNA, 23 bp, synthetic construct
  source 1..23: mol_type = other DNA
cagtrcctcaatgcaccaggagg

SEQ ID NO: 2585 - DNA, 23 bp, synthetic construct
  source 1..23: mol_type = other DNA
ggccagtrcctcaatgcaccagg

SEQ ID NO: 2586 - DNA, 23 bp, synthetic construct
  source 1..23: mol_type = other DNA
caatgaatrtggctctgcgcagg

SEQ ID NO: 2587 - DNA, 23 bp, synthetic construct
  source 1..23: mol_type = other DNA
ggttcacrcaacggccattgggg

SEQ ID NO: 2588 - DNA, 23 bp, synthetic construct
  source 1..23: mol_type = other DNA
aggttcacrcaacggccattggg

SEQ ID NO: 2589 - DNA, 23 bp, synthetic construct
  source 1..23: mol_type = other DNA
ggacagtrcatcaatacagatgg

SEQ ID NO: 2590 - DNA, 23 bp, synthetic construct
  source 1..23: mol_type = other DNA
atgcrgtggcggccagcaatagg

SEQ ID NO: 2591 - DNA, 23 bp, synthetic construct
  source 1..23: mol_type = other DNA
gccrttgcgtgaacctcataggg

SEQ ID NO: 2592 - DNA, 23 bp, synthetic construct
  source 1..23: mol_type = other DNA
ggccrttgcgtgaacctcatagg

SEQ ID NO: 2593 - DNA, 23 bp, synthetic construct
  source 1..23: mol_type = other DNA
ggtgtttrccataacacagaggg

SEQ ID NO: 2594 - DNA, 23 bp, synthetic construct
  source 1..23: mol_type = other DNA
tggtgtttrccataacacagagg

SEQ ID NO: 2595 - DNA, 23 bp, synthetic construct
  source 1..23: mol_type = other DNA
tatgaatrtagctgtcagccggg

SEQ ID NO: 2596 - DNA, 23 bp, synthetic construct
  source 1..23: mol_type = other DNA
ctatgaatrtagctgtcagccgg

SEQ ID NO: 2597 - DNA, 23 bp, synthetic construct
  source 1..23: mol_type = other DNA
ccagtrtgtgaacacccctgggg

SEQ ID NO: 2598 - DNA, 23 bp, synthetic construct
  source 1..23: mol_type = other DNA
gccagtrtgtgaacacccctggg

SEQ ID NO: 2599 - DNA, 23 bp, synthetic construct
  source 1..23: mol_type = other DNA
ggccagtrtgtgaacacccctgg

SEQ ID NO: 2600 - DNA, 23 bp, synthetic construct
  source 1..23: mol_type = other DNA
gaatccccrctggcattcacagg

SEQ ID NO: 2601 - DNA, 23 bp, synthetic construct
  source 1..23: mol_type = other DNA
cctggaggggaaggtttcygacc

SEQ ID NO: 2602 - DNA, 23 bp, synthetic construct
  source 1..23: mol_type = other DNA
cccttccagacaatygggaaggg

SEQ ID NO: 2603 - DNA, 23 bp, synthetic construct
  source 1..23: mol_type = other DNA
ccggatctgcaataatggaygct

SEQ ID NO: 2604 - DNA, 23 bp, synthetic construct
  source 1..23: mol_type = other DNA
cctccctcggtgctgygtgggga

SEQ ID NO: 2605 - DNA, 23 bp, synthetic construct
  source 1..23: mol_type = other DNA
cccgtgcaccctatgcyaagttg

SEQ ID NO: 2606 - DNA, 23 bp, synthetic construct
  source 1..23: mol_type = other DNA
ccgtgcaccctatgcyaagttgg

SEQ ID NO: 2607 - DNA, 23 bp, synthetic construct
  source 1..23: mol_type = other DNA
cctttgggagtttcyagtgccgc

SEQ ID NO: 2608 - DNA, 23 bp, synthetic construct
  source 1..23: mol_type = other DNA
ccctgcctattgctggcygccac

SEQ ID NO: 2609 - DNA, 23 bp, synthetic construct
  source 1..23: mol_type = other DNA
cctgcctattgctggcygccacc

SEQ ID NO: 2610 - DNA, 23 bp, synthetic construct
  source 1..23: mol_type = other DNA
ccacctggttacttcygcatagg

SEQ ID NO: 2611 - DNA, 23 bp, synthetic construct
  source 1..23: mol_type = other DNA
cctgaatgaagatacaygagtgt

SEQ ID NO: 2612 - DNA, 23 bp, synthetic construct
  source 1..23: mol_type = other DNA
cctctgctctgtgccttcygatg

SEQ ID NO: 2613 - DNA, 23 bp, synthetic construct
  source 1..23: mol_type = other DNA
cctcaaattccggtccctygacc

SEQ ID NO: 2614 - DNA, 23 bp, synthetic construct
  source 1..23: mol_type = other DNA
cccaatgtctgtggatcaygtta

SEQ ID NO: 2615 - DNA, 23 bp, synthetic construct
  source 1..23: mol_type = other DNA
ccaatgtctgtggatcaygttat

SEQ ID NO: 2616 - DNA, 23 bp, synthetic construct
  source 1..23: mol_type = other DNA
tgtragcctggccgctgctgggg

SEQ ID NO: 2617 - DNA, 23 bp, synthetic construct
  source 1..23: mol_type = other DNA
ctgtragcctggccgctgctggg

SEQ ID NO: 2618 - DNA, 23 bp, synthetic construct
  source 1..23: mol_type = other DNA
gctgtragcctggccgctgctgg

SEQ ID NO: 2619 - DNA, 23 bp, synthetic construct
  source 1..23: mol_type = other DNA
gcagccrgctacgcactgtatgg

SEQ ID NO: 2620 - DNA, 23 bp, synthetic construct
  source 1..23: mol_type = other DNA
ccaagtgtaaaaaactcyggacc

SEQ ID NO: 2621 - DNA, 23 bp, synthetic construct
  source 1..23: mol_type = other DNA
cccgagacggagccgaygctggg

SEQ ID NO: 2622 - DNA, 23 bp, synthetic construct
  source 1..23: mol_type = other DNA
ccgagacggagccgaygctgggg

SEQ ID NO: 2623 - DNA, 23 bp, synthetic construct
  source 1..23: mol_type = other DNA
ccgctctgtgtcaatyctgtctg

SEQ ID NO: 2624 - DNA, 23 bp, synthetic construct
  source 1..23: mol_type = other DNA
ccttatggaacaaggcatcyaag

SEQ ID NO: 2625 - DNA, 23 bp, synthetic construct
  source 1..23: mol_type = other DNA
atgrgagctgcgggtgtttgtgg

SEQ ID NO: 2626 - DNA, 23 bp, synthetic construct
  source 1..23: mol_type = other DNA
ccaggtgrctggactcgtcgcgg

SEQ ID NO: 2627 - DNA, 23 bp, synthetic construct
  source 1..23: mol_type = other DNA
ccccccgtttccagygaaagttc

SEQ ID NO: 2628 - DNA, 23 bp, synthetic construct
  source 1..23: mol_type = other DNA
cctgggcatcgccaacaacygac

SEQ ID NO: 2629 - DNA, 23 bp, synthetic construct
  source 1..23: mol_type = other DNA
cgtgcrtggcccaagggttgtgg

SEQ ID NO: 2630 - DNA, 23 bp, synthetic construct
  source 1..23: mol_type = other DNA
ccaggtaacgaacaggyatgcaa

SEQ ID NO: 2631 - DNA, 23 bp, synthetic construct
  source 1..23: mol_type = other DNA
cccagccacagcctctgccytgg

SEQ ID NO: 2632 - DNA, 23 bp, synthetic construct
  source 1..23: mol_type = other DNA
ccagccacagcctctgccytggg

SEQ ID NO: 2633 - DNA, 23 bp, synthetic construct
  source 1..23: mol_type = other DNA
ccacagcctctgccytgggcccc

SEQ ID NO: 2634 - DNA, 23 bp, synthetic construct
  source 1..23: mol_type = other DNA
ccaacctcaatctgcctygaacc

SEQ ID NO: 2635 - DNA, 23 bp, synthetic construct
  source 1..23: mol_type = other DNA
ccagagctggagaaaygaatgca

SEQ ID NO: 2636 - DNA, 23 bp, synthetic construct
  source 1..23: mol_type = other DNA
ccatgaacaagaggggaygactc

SEQ ID NO: 2637 - DNA, 23 bp, synthetic construct
  source 1..23: mol_type = other DNA
cctctaggaaggccygggcaggg

SEQ ID NO: 2638 - DNA, 23 bp, synthetic construct
  source 1..23: mol_type = other DNA
tatcartatagcagtgggcctgg

SEQ ID NO: 2639 - DNA, 23 bp, synthetic construct
  source 1..23: mol_type = other DNA
ccagartgaagatctcccacagg

SEQ ID NO: 2640 - DNA, 23 bp, synthetic construct
  source 1..23: mol_type = other DNA
ccggatctacacccacyagagtg

SEQ ID NO: 2641 - DNA, 23 bp, synthetic construct
  source 1..23: mol_type = other DNA
ccacctgcccaaagcagycctct

SEQ ID NO: 2642 - DNA, 23 bp, synthetic construct
  source 1..23: mol_type = other DNA
cctgcccaaagcagycctctccc

SEQ ID NO: 2643 - DNA, 23 bp, synthetic construct
  source 1..23: mol_type = other DNA
gcttggcrggtaattctattggg

SEQ ID NO: 2644 - DNA, 23 bp, synthetic construct
  source 1..23: mol_type = other DNA
tgcttggcrggtaattctattgg

SEQ ID NO: 2645 - DNA, 23 bp, synthetic construct
  source 1..23: mol_type = other DNA
tttarcagccagaaatgttttgg

SEQ ID NO: 2646 - DNA, 23 bp, synthetic construct
  source 1..23: mol_type = other DNA
cacagacratgccactgacaagg

SEQ ID NO: 2647 - DNA, 23 bp, synthetic construct
  source 1..23: mol_type = other DNA
cctgccctcgatacagccyggcc

SEQ ID NO: 2648 - DNA, 23 bp, synthetic construct
  source 1..23: mol_type = other DNA
ccctcgatacagccyggccagca

SEQ ID NO: 2649 - DNA, 23 bp, synthetic construct
  source 1..23: mol_type = other DNA
cgctrgaaggctgagcgcgaggg

SEQ ID NO: 2650 - DNA, 23 bp, synthetic construct
  source 1..23: mol_type = other DNA
gcgctrgaaggctgagcgcgagg

SEQ ID NO: 2651 - DNA, 23 bp, synthetic construct
  source 1..23: mol_type = other DNA
cccgagcacttcctgcagcygct

SEQ ID NO: 2652 - DNA, 23 bp, synthetic construct
  source 1..23: mol_type = other DNA
ccgagcacttcctgcagcygctg

SEQ ID NO: 2653 - DNA, 23 bp, synthetic construct
  source 1..23: mol_type = other DNA
cctagtacctgatggggcgyggg

SEQ ID NO: 2654 - DNA, 23 bp, synthetic construct
  source 1..23: mol_type = other DNA
cctggccaggggcttcyagcgct

SEQ ID NO: 2655 - DNA, 23 bp, synthetic construct
  source 1..23: mol_type = other DNA
ccctccggcacatgaggyaggta

SEQ ID NO: 2656 - DNA, 23 bp, synthetic construct
  source 1..23: mol_type = other DNA
cctccggcacatgaggyaggtag

SEQ ID NO: 2657 - DNA, 23 bp, synthetic construct
  source 1..23: mol_type = other DNA
cccaaagaggacacayagaagct

SEQ ID NO: 2658 - DNA, 23 bp, synthetic construct
  source 1..23: mol_type = other DNA
ccaaagaggacacayagaagctg

SEQ ID NO: 2659 - DNA, 23 bp, synthetic construct
  source 1..23: mol_type = other DNA
tgacrgtgaggaggggtgggggg

SEQ ID NO: 2660 - DNA, 23 bp, synthetic construct
  source 1..23: mol_type = other DNA
gtgacrgtgaggaggggtggggg

SEQ ID NO: 2661 - DNA, 23 bp, synthetic construct
  source 1..23: mol_type = other DNA
agtgacrgtgaggaggggtgggg

SEQ ID NO: 2662 - DNA, 23 bp, synthetic construct
  source 1..23: mol_type = other DNA
aagtgacrgtgaggaggggtggg

SEQ ID NO: 2663 - DNA, 23 bp, synthetic construct
  source 1..23: mol_type = other DNA
caagtgacrgtgaggaggggtgg

SEQ ID NO: 2664 - DNA, 23 bp, synthetic construct
  source 1..23: mol_type = other DNA
ccattgagatctgctyggaggcg

SEQ ID NO: 2665 - DNA, 23 bp, synthetic construct
  source 1..23: mol_type = other DNA
ccgcaggaggctggygagtatgc

SEQ ID NO: 2666 - DNA, 23 bp, synthetic construct
  source 1..23: mol_type = other DNA
ccaagggggatgcagtgygagat

SEQ ID NO: 2667 - DNA, 23 bp, synthetic construct
  source 1..23: mol_type = other DNA
ccagaacaagctgccgyagctgc

SEQ ID NO: 2668 - DNA, 23 bp, synthetic construct
  source 1..23: mol_type = other DNA
ccaagtggactgctygagcgcgg

SEQ ID NO: 2669 - DNA, 23 bp, synthetic construct
  source 1..23: mol_type = other DNA
ccgggactggcagagcggcyggg

SEQ ID NO: 2670 - DNA, 23 bp, synthetic construct
  source 1..23: mol_type = other DNA
gtccagrgttggaagctgtaggg

SEQ ID NO: 2671 - DNA, 23 bp, synthetic construct
  source 1..23: mol_type = other DNA
ggtccagrgttggaagctgtagg

SEQ ID NO: 2672 - DNA, 23 bp, synthetic construct
  source 1..23: mol_type = other DNA
aagactrggcgctatatgattgg

SEQ ID NO: 2673 - DNA, 23 bp, synthetic construct
  source 1..23: mol_type = other DNA
cctttgcttcaggttygagcata

SEQ ID NO: 2674 - DNA, 23 bp, synthetic construct
  source 1..23: mol_type = other DNA
cctcctgctgctgggygatacac

SEQ ID NO: 2675 - DNA, 23 bp, synthetic construct
  source 1..23: mol_type = other DNA
gtggccrtgaaaatgctgaaagg

SEQ ID NO: 2676 - DNA, 23 bp, synthetic construct
  source 1..23: mol_type = other DNA
ctctggragatcttctctctggg

SEQ ID NO: 2677 - DNA, 23 bp, synthetic construct
  source 1..23: mol_type = other DNA
tctctggragatcttctctctgg

SEQ ID NO: 2678 - DNA, 23 bp, synthetic construct
  source 1..23: mol_type = other DNA
cggcrccttcgggaaggtggtgg

SEQ ID NO: 2679 - DNA, 23 bp, synthetic construct
  source 1..23: mol_type = other DNA
ctacggcrccttcgggaaggtgg

SEQ ID NO: 2680 - DNA, 23 bp, synthetic construct
  source 1..23: mol_type = other DNA
ccgcaggagaagtctyccgagca

SEQ ID NO: 2681 - DNA, 23 bp, synthetic construct
  source 1..23: mol_type = other DNA
caccrccgtgctgggcaatcagg

SEQ ID NO: 2682 - DNA, 23 bp, synthetic construct
  source 1..23: mol_type = other DNA
tttragaagagcaatgacattgg

SEQ ID NO: 2683 - DNA, 23 bp, synthetic construct
  source 1..23: mol_type = other DNA
aaaaragtcctttccaggtaagg

SEQ ID NO: 2684 - DNA, 23 bp, synthetic construct
  source 1..23: mol_type = other DNA
ccggacatcatgtgtatcycaac

SEQ ID NO: 2685 - DNA, 23 bp, synthetic construct
  source 1..23: mol_type = other DNA
ccgccgccgcccgcgycctccgc

SEQ ID NO: 2686 - DNA, 23 bp, synthetic construct
  source 1..23: mol_type = other DNA
ccctacctcggcggcgagyagag

SEQ ID NO: 2687 - DNA, 23 bp, synthetic construct
  source 1..23: mol_type = other DNA
cctacctcggcggcgagyagagc

SEQ ID NO: 2688 - DNA, 23 bp, synthetic construct
  source 1..23: mol_type = other DNA
ccgccacaacctctygctcaacg

SEQ ID NO: 2689 - DNA, 23 bp, synthetic construct
  source 1..23: mol_type = other DNA
ccacaacagccaccaccccyagc

SEQ ID NO: 2690 - DNA, 23 bp, synthetic construct
  source 1..23: mol_type = other DNA
ccccgagaagcggctcacgytca

SEQ ID NO: 2691 - DNA, 23 bp, synthetic construct
  source 1..23: mol_type = other DNA
cccgagaagcggctcacgytcaa

SEQ ID NO: 2692 - DNA, 23 bp, synthetic construct
  source 1..23: mol_type = other DNA
ccgagaagcggctcacgytcaac

SEQ ID NO: 2693 - DNA, 23 bp, synthetic construct
  source 1..23: mol_type = other DNA
ccatccgccacaatctgtycctc

SEQ ID NO: 2694 - DNA, 23 bp, synthetic construct
  source 1..23: mol_type = other DNA
ccgccacaatctgtycctcaaca

SEQ ID NO: 2695 - DNA, 23 bp, synthetic construct
  source 1..23: mol_type = other DNA
ccgccgccgcagcagcagyagcc

SEQ ID NO: 2696 - DNA, 23 bp, synthetic construct
  source 1..23: mol_type = other DNA
ccgccgcagcagcagyagccgcc

SEQ ID NO: 2697 - DNA, 23 bp, synthetic construct
  source 1..23: mol_type = other DNA
tccgcragagcgcggagaagagg

SEQ ID NO: 2698 - DNA, 23 bp, synthetic construct
  source 1..23: mol_type = other DNA
ccccccaagtacctgyagtctgg

SEQ ID NO: 2699 - DNA, 23 bp, synthetic construct
  source 1..23: mol_type = other DNA
cccccaagtacctgyagtctggc

SEQ ID NO: 2700 - DNA, 23 bp, synthetic construct
  source 1..23: mol_type = other DNA
ccctatgcctcctgcyagatggc

SEQ ID NO: 2701 - DNA, 23 bp, synthetic construct
  source 1..23: mol_type = other DNA
cctatgcctcctgcyagatggcg

SEQ ID NO: 2702 - DNA, 23 bp, synthetic construct
  source 1..23: mol_type = other DNA
ccgatrcccaaccccaggcctgg

SEQ ID NO: 2703 - DNA, 23 bp, synthetic construct
  source 1..23: mol_type = other DNA
cctggtgtcattgaayaggtgcg

SEQ ID NO: 2704 - DNA, 23 bp, synthetic construct
  source 1..23: mol_type = other DNA
agtrgaccctggacatctgcggg

SEQ ID NO: 2705 - DNA, 23 bp, synthetic construct
  source 1..23: mol_type = other DNA
cagtrgaccctggacatctgcgg

SEQ ID NO: 2706 - DNA, 23 bp, synthetic construct
  source 1..23: mol_type = other DNA
cccatctcagtaccatgaaygac

SEQ ID NO: 2707 - DNA, 23 bp, synthetic construct
  source 1..23: mol_type = other DNA
ccatctcagtaccatgaaygaca

SEQ ID NO: 2708 - DNA, 23 bp, synthetic construct
  source 1..23: mol_type = other DNA
ccaggatcgccaagygcatggcc

SEQ ID NO: 2709 - DNA, 23 bp, synthetic construct
  source 1..23: mol_type = other DNA
ccaggatggacagtygccggacc

SEQ ID NO: 2710 - DNA, 23 bp, synthetic construct
  source 1..23: mol_type = other DNA
agacrccatgaaagctgccatgg

SEQ ID NO: 2711 - DNA, 23 bp, synthetic construct
  source 1..23: mol_type = other DNA
cctgcaggcctcctacayctacc

SEQ ID NO: 2712 - DNA, 23 bp, synthetic construct
  source 1..23: mol_type = other DNA
acaracaggatcgcagggagagg

SEQ ID NO: 2713 - DNA, 23 bp, synthetic construct
  source 1..23: mol_type = other DNA
tgagcacaracaggatcgcaggg

SEQ ID NO: 2714 - DNA, 23 bp, synthetic construct
  source 1..23: mol_type = other DNA
tggctttgrccctggcaagatgg

SEQ ID NO: 2715 - DNA, 23 bp, synthetic construct
  source 1..23: mol_type = other DNA
cagcrgtggctatggacagcagg

SEQ ID NO: 2716 - DNA, 23 bp, synthetic construct
  source 1..23: mol_type = other DNA
gctgragtcctgtcaggtatggg

SEQ ID NO: 2717 - DNA, 23 bp, synthetic construct
  source 1..23: mol_type = other DNA
tgctgragtcctgtcaggtatgg

SEQ ID NO: 2718 - DNA, 23 bp, synthetic construct
  source 1..23: mol_type = other DNA
tggacagcrtccatactggtggg

SEQ ID NO: 2719 - DNA, 23 bp, synthetic construct
  source 1..23: mol_type = other DNA
gatccrcgtgcagcccaacgagg

SEQ ID NO: 2720 - DNA, 23 bp, synthetic construct
  source 1..23: mol_type = other DNA
gatgctgtrtctggtggccatgg

SEQ ID NO: 2721 - DNA, 23 bp, synthetic construct
  source 1..23: mol_type = other DNA
cctgcagagctctgacyggctgt

SEQ ID NO: 2722 - DNA, 23 bp, synthetic construct
  source 1..23: mol_type = other DNA
ccagatgcacttcgtgygcaggt

SEQ ID NO: 2723 - DNA, 23 bp, synthetic construct
  source 1..23: mol_type = other DNA
ccgtgaggaccagatctacygca

SEQ ID NO: 2724 - DNA, 23 bp, synthetic construct
  source 1..23: mol_type = other DNA
ccaccagcagtgcaagygcaacg

SEQ ID NO: 2725 - DNA, 23 bp, synthetic construct
  source 1..23: mol_type = other DNA
cctgcgctgcggcaaggycctga

SEQ ID NO: 2726 - DNA, 23 bp, synthetic construct
  source 1..23: mol_type = other DNA
ctggtcrgggccgacgtctgcgg

SEQ ID NO: 2727 - DNA, 23 bp, synthetic construct
  source 1..23: mol_type = other DNA
gaargtagggcgagggtccaggg

SEQ ID NO: 2728 - DNA, 23 bp, synthetic construct
  source 1..23: mol_type = other DNA
ggaargtagggcgagggtccagg

SEQ ID NO: 2729 - DNA, 23 bp, synthetic construct
  source 1..23: mol_type = other DNA
ccacagagtcccgcyagcagccc

SEQ ID NO: 2730 - DNA, 23 bp, synthetic construct
  source 1..23: mol_type = other DNA
cccaccctacgtgcytggtcagc

SEQ ID NO: 2731 - DNA, 23 bp, synthetic construct
  source 1..23: mol_type = other DNA
ccaagggtggggaggccygaggg

SEQ ID NO: 2732 - DNA, 23 bp, synthetic construct
  source 1..23: mol_type = other DNA
cctccrgttaaataacctaatgg

SEQ ID NO: 2733 - DNA, 23 bp, synthetic construct
  source 1..23: mol_type = other DNA
tgcccrgaaatcgctccccaagg

SEQ ID NO: 2734 - DNA, 23 bp, synthetic construct
  source 1..23: mol_type = other DNA
aaacttcrgcctgatataggagg

SEQ ID NO: 2735 - DNA, 23 bp, synthetic construct
  source 1..23: mol_type = other DNA
cccaagatcagcaaccattyaaa

SEQ ID NO: 2736 - DNA, 23 bp, synthetic construct
  source 1..23: mol_type = other DNA
ccaagatcagcaaccattyaaat

SEQ ID NO: 2737 - DNA, 23 bp, synthetic construct
  source 1..23: mol_type = other DNA
ccattaaagtcctcygattgaac

SEQ ID NO: 2738 - DNA, 23 bp, synthetic construct
  source 1..23: mol_type = other DNA
tttgcggrgctcaaggccgtggg

SEQ ID NO: 2739 - DNA, 23 bp, synthetic construct
  source 1..23: mol_type = other DNA
ctttgcggrgctcaaggccgtgg

SEQ ID NO: 2740 - DNA, 23 bp, synthetic construct
  source 1..23: mol_type = other DNA
tggrgtggacagcagccttaggg

SEQ ID NO: 2741 - DNA, 23 bp, synthetic construct
  source 1..23: mol_type = other DNA
ctggrgtggacagcagccttagg

SEQ ID NO: 2742 - DNA, 23 bp, synthetic construct
  source 1..23: mol_type = other DNA
cccttctctgcaggtgtcyggga

SEQ ID NO: 2743 - DNA, 23 bp, synthetic construct
  source 1..23: mol_type = other DNA
ccttctctgcaggtgtcygggat

SEQ ID NO: 2744 - DNA, 23 bp, synthetic construct
  source 1..23: mol_type = other DNA
ccaccttctacctctctyaagca

SEQ ID NO: 2745 - DNA, 23 bp, synthetic construct
  source 1..23: mol_type = other DNA
ccttctacctctctyaagcagcc

SEQ ID NO: 2746 - DNA, 23 bp, synthetic construct
  source 1..23: mol_type = other DNA
ttgraccggatggctgcagaagg

SEQ ID NO: 2747 - DNA, 23 bp, synthetic construct
  source 1..23: mol_type = other DNA
cacrgatttgatgagtggtttgg

SEQ ID NO: 2748 - DNA, 23 bp, synthetic construct
  source 1..23: mol_type = other DNA
tgaagcacrgatttgatgagtgg

SEQ ID NO: 2749 - DNA, 23 bp, synthetic construct
  source 1..23: mol_type = other DNA
cctatcttctattacygtggcga

SEQ ID NO: 2750 - DNA, 23 bp, synthetic construct
  source 1..23: mol_type = other DNA
catgtrcttccacccctggtcgg

SEQ ID NO: 2751 - DNA, 23 bp, synthetic construct
  source 1..23: mol_type = other DNA
tatccrctacaacccgctgcagg

SEQ ID NO: 2752 - DNA, 23 bp, synthetic construct
  source 1..23: mol_type = other DNA
ctcraggagtctggtaactatgg

SEQ ID NO: 2753 - DNA, 23 bp, synthetic construct
  source 1..23: mol_type = other DNA
tccrggctgttgttgatgcatgg

SEQ ID NO: 2754 - DNA, 23 bp, synthetic construct
  source 1..23: mol_type = other DNA
tgcatgrgcctcagtcacagagg

SEQ ID NO: 2755 - DNA, 23 bp, synthetic construct
  source 1..23: mol_type = other DNA
ctgccagrtaagggtgtcagggg

SEQ ID NO: 2756 - DNA, 23 bp, synthetic construct
  source 1..23: mol_type = other DNA
actgccagrtaagggtgtcaggg

SEQ ID NO: 2757 - DNA, 23 bp, synthetic construct
  source 1..23: mol_type = other DNA
gcgtgagragcgatctcagcagg

SEQ ID NO: 2758 - DNA, 23 bp, synthetic construct
  source 1..23: mol_type = other DNA
gctaatgragtacagccgccagg

SEQ ID NO: 2759 - DNA, 23 bp, synthetic construct
  source 1..23: mol_type = other DNA
gatcaraggctggggccaactgg

SEQ ID NO: 2760 - DNA, 23 bp, synthetic construct
  source 1..23: mol_type = other DNA
tcctgcrctctgccactgtccgg

SEQ ID NO: 2761 - DNA, 23 bp, synthetic construct
  source 1..23: mol_type = other DNA
ccargctgcagagagactaaggg

SEQ ID NO: 2762 - DNA, 23 bp, synthetic construct
  source 1..23: mol_type = other DNA
tccargctgcagagagactaagg

SEQ ID NO: 2763 - DNA, 23 bp, synthetic construct
  source 1..23: mol_type = other DNA
ccattggcagctgcacgctyatt

SEQ ID NO: 2764 - DNA, 23 bp, synthetic construct
  source 1..23: mol_type = other DNA
cctgccagatattgcccagygtg

SEQ ID NO: 2765 - DNA, 23 bp, synthetic construct
  source 1..23: mol_type = other DNA
ccagatattgcccagygtgagga

SEQ ID NO: 2766 - DNA, 23 bp, synthetic construct
  source 1..23: mol_type = other DNA
ccaagtatgacaacytctttgag

SEQ ID NO: 2767 - DNA, 23 bp, synthetic construct
  source 1..23: mol_type = other DNA
ccctccgctcctgcgctytgcca

SEQ ID NO: 2768 - DNA, 23 bp, synthetic construct
  source 1..23: mol_type = other DNA
cctccgctcctgcgctytgccac

SEQ ID NO: 2769 - DNA, 23 bp, synthetic construct
  source 1..23: mol_type = other DNA
cctccgctcctgcgctctgycac

SEQ ID NO: 2770 - DNA, 23 bp, synthetic construct
  source 1..23: mol_type = other DNA
ccgctcctgcgctctgycactgt

SEQ ID NO: 2771 - DNA, 23 bp, synthetic construct
  source 1..23: mol_type = other DNA
ccatgatgggctgttytaacccc

SEQ ID NO: 2772 - DNA, 23 bp, synthetic construct
  source 1..23: mol_type = other DNA
ccagacactgctgctgcccygtc

SEQ ID NO: 2773 - DNA, 23 bp, synthetic construct
  source 1..23: mol_type = other DNA
ccgcatgaagcggccctggyagg

SEQ ID NO: 2774 - DNA, 23 bp, synthetic construct
  source 1..23: mol_type = other DNA
cccctggtcggatgtaaygctgc

SEQ ID NO: 2775 - DNA, 23 bp, synthetic construct
  source 1..23: mol_type = other DNA
ccctggtcggatgtaaygctgcc

SEQ ID NO: 2776 - DNA, 23 bp, synthetic construct
  source 1..23: mol_type = other DNA
cctggtcggatgtaaygctgcca

SEQ ID NO: 2777 - DNA, 23 bp, synthetic construct
  source 1..23: mol_type = other DNA
ccagacactgctgctgcycgtcg

SEQ ID NO: 2778 - DNA, 23 bp, synthetic construct
  source 1..23: mol_type = other DNA
actrcaacctcacctcctggggg

SEQ ID NO: 2779 - DNA, 23 bp, synthetic construct
  source 1..23: mol_type = other DNA
tactrcaacctcacctcctgggg

SEQ ID NO: 2780 - DNA, 23 bp, synthetic construct
  source 1..23: mol_type = other DNA
ctactrcaacctcacctcctggg

SEQ ID NO: 2781 - DNA, 23 bp, synthetic construct
  source 1..23: mol_type = other DNA
cctactrcaacctcacctcctgg

SEQ ID NO: 2782 - DNA, 23 bp, synthetic construct
  source 1..23: mol_type = other DNA
caargtgcccctctgcccgcagg

SEQ ID NO: 2783 - DNA, 23 bp, synthetic construct
  source 1..23: mol_type = other DNA
ccgaagtcgtgaggacgccyagg

SEQ ID NO: 2784 - DNA, 23 bp, synthetic construct
  source 1..23: mol_type = other DNA
ctgtggcrgagggacaggacagg

SEQ ID NO: 2785 - DNA, 23 bp, synthetic construct
  source 1..23: mol_type = other DNA
ccactccactgtggyggagggac

SEQ ID NO: 2786 - DNA, 23 bp, synthetic construct
  source 1..23: mol_type = other DNA
cctacccctcctatgtgcyggcg

SEQ ID NO: 2787 - DNA, 23 bp, synthetic construct
  source 1..23: mol_type = other DNA
cccctcctatgtgcyggcggctg

SEQ ID NO: 2788 - DNA, 23 bp, synthetic construct
  source 1..23: mol_type = other DNA
ccactcatcaagcccaagygaag

SEQ ID NO: 2789 - DNA, 23 bp, synthetic construct
  source 1..23: mol_type = other DNA
ccccactgtggcggygagatggc

SEQ ID NO: 2790 - DNA, 23 bp, synthetic construct
  source 1..23: mol_type = other DNA
gcagractcttggaacagcctgg

SEQ ID NO: 2791 - DNA, 23 bp, synthetic construct
  source 1..23: mol_type = other DNA
cctccgtgctgggcctgtyctac

SEQ ID NO: 2792 - DNA, 23 bp, synthetic construct
  source 1..23: mol_type = other DNA
ccgtgctgggcctgtyctacctc

SEQ ID NO: 2793 - DNA, 23 bp, synthetic construct
  source 1..23: mol_type = other DNA
cctcccgccagcggtgyttccag

SEQ ID NO: 2794 - DNA, 23 bp, synthetic construct
  source 1..23: mol_type = other DNA
cctactccagcccctacycggct

SEQ ID NO: 2795 - DNA, 23 bp, synthetic construct
  source 1..23: mol_type = other DNA
ccagaccaccaccaccaygctgt

SEQ ID NO: 2796 - DNA, 23 bp, synthetic construct
  source 1..23: mol_type = other DNA
ttatggcrcagaaacgccgaggg

SEQ ID NO: 2797 - DNA, 23 bp, synthetic construct
  source 1..23: mol_type = other DNA
cttatggcrcagaaacgccgagg

SEQ ID NO: 2798 - DNA, 23 bp, synthetic construct
  source 1..23: mol_type = other DNA
aaccrgtgagggcaatggtgagg

SEQ ID NO: 2799 - DNA, 23 bp, synthetic construct
  source 1..23: mol_type = other DNA
atgtggtcrgctggaccgactgg

SEQ ID NO: 2800 - DNA, 23 bp, synthetic construct
  source 1..23: mol_type = other DNA
ccaacgcttgctgctgcyccact

SEQ ID NO: 2801 - DNA, 23 bp, synthetic construct
  source 1..23: mol_type = other DNA
ccctgcagttggcccagygtccc

SEQ ID NO: 2802 - DNA, 23 bp, synthetic construct
  source 1..23: mol_type = other DNA
cctgcagttggcccagygtcccg

SEQ ID NO: 2803 - DNA, 23 bp, synthetic construct
  source 1..23: mol_type = other DNA
tccrctcactggcctacatgcgg

SEQ ID NO: 2804 - DNA, 23 bp, synthetic construct
  source 1..23: mol_type = other DNA
ccatgccctctatcccygagcct

SEQ ID NO: 2805 - DNA, 23 bp, synthetic construct
  source 1..23: mol_type = other DNA
tgattcractcattacgcatggg

SEQ ID NO: 2806 - DNA, 23 bp, synthetic construct
  source 1..23: mol_type = other DNA
atgattcractcattacgcatgg

SEQ ID NO: 2807 - DNA, 23 bp, synthetic construct
  source 1..23: mol_type = other DNA
gtgtgrgctcggtgtgaagatgg

SEQ ID NO: 2808 - DNA, 23 bp, synthetic construct
  source 1..23: mol_type = other DNA
acacctacraaggtaggagctgg

SEQ ID NO: 2809 - DNA, 23 bp, synthetic construct
  source 1..23: mol_type = other DNA
gcctgctgragtcggggtagtgg

SEQ ID NO: 2810 - DNA, 23 bp, synthetic construct
  source 1..23: mol_type = other DNA
cacatrtgtatggtaatgcgagg

SEQ ID NO: 2811 - DNA, 23 bp, synthetic construct
  source 1..23: mol_type = other DNA
cccgaggccaagagcgcgyagcc

SEQ ID NO: 2812 - DNA, 23 bp, synthetic construct
  source 1..23: mol_type = other DNA
ccgaggccaagagcgcgyagccc

SEQ ID NO: 2813 - DNA, 23 bp, synthetic construct
  source 1..23: mol_type = other DNA
agtcrgggacttcctctccctgg

SEQ ID NO: 2814 - DNA, 23 bp, synthetic construct
  source 1..23: mol_type = other DNA
cttcrgggactccggcgagctgg

SEQ ID NO: 2815 - DNA, 23 bp, synthetic construct
  source 1..23: mol_type = other DNA
ctcggcgrtggcctgtaagaagg

SEQ ID NO: 2816 - DNA, 23 bp, synthetic construct
  source 1..23: mol_type = other DNA
gcgcrctgcgcacatgtgctcgg

SEQ ID NO: 2817 - DNA, 23 bp, synthetic construct
  source 1..23: mol_type = other DNA
ggtgragaggtgtgcggaggagg

SEQ ID NO: 2818 - DNA, 23 bp, synthetic construct
  source 1..23: mol_type = other DNA
gcaggtgragaggtgtgcggagg

SEQ ID NO: 2819 - DNA, 23 bp, synthetic construct
  source 1..23: mol_type = other DNA
catgraggagatgcagaatgtgg

SEQ ID NO: 2820 - DNA, 23 bp, synthetic construct
  source 1..23: mol_type = other DNA
ccctggtctcggcggtggyctgt

SEQ ID NO: 2821 - DNA, 23 bp, synthetic construct
  source 1..23: mol_type = other DNA
cctggtctcggcggtggyctgta

SEQ ID NO: 2822 - DNA, 23 bp, synthetic construct
  source 1..23: mol_type = other DNA
ccgacctccaccccaggcayggg

SEQ ID NO: 2823 - DNA, 23 bp, synthetic construct
  source 1..23: mol_type = other DNA
cctccaccccaggcaygggctgc

SEQ ID NO: 2824 - DNA, 23 bp, synthetic construct
  source 1..23: mol_type = other DNA
atgraaacggagacttaaagtgg

SEQ ID NO: 2825 - DNA, 23 bp, synthetic construct
  source 1..23: mol_type = other DNA
ccagrctgacctgaactgcctgg

SEQ ID NO: 2826 - DNA, 23 bp, synthetic construct
  source 1..23: mol_type = other DNA
gttgrtttgcttgcaggagtggg

SEQ ID NO: 2827 - DNA, 23 bp, synthetic construct
  source 1..23: mol_type = other DNA
ggttgrtttgcttgcaggagtgg

SEQ ID NO: 2828 - DNA, 23 bp, synthetic construct
  source 1..23: mol_type = other DNA
ccagctattcattaacttcyggg

SEQ ID NO: 2829 - DNA, 23 bp, synthetic construct
  source 1..23: mol_type = other DNA
tgccrattccgctctcttctagg

SEQ ID NO: 2830 - skipped

SEQ ID NO: 2831 - DNA, 23 bp, synthetic construct
  source 1..23: mol_type = other DNA
ccctgaaagagatcygcacgcag

SEQ ID NO: 2832 - DNA, 23 bp, synthetic construct
  source 1..23: mol_type = other DNA
atgagcrctggcgcgacggctgg

SEQ ID NO: 2833 - DNA, 23 bp, synthetic construct
  source 1..23: mol_type = other DNA
cctaatgaaaaaataygaaatat

SEQ ID NO: 2834 - DNA, 23 bp, synthetic construct
  source 1..23: mol_type = other DNA
gctgcagrgggaagtgactgtgg

SEQ ID NO: 2835 - DNA, 23 bp, synthetic construct
  source 1..23: mol_type = other DNA
tgaccrcttccagcagaggtggg

SEQ ID NO: 2836 - DNA, 23 bp, synthetic construct
  source 1..23: mol_type = other DNA
atgaccrcttccagcagaggtgg

SEQ ID NO: 2837 - DNA, 23 bp, synthetic construct
  source 1..23: mol_type = other DNA
tgctggtcrtgcactggggtggg

SEQ ID NO: 2838 - DNA, 23 bp, synthetic construct
  source 1..23: mol_type = other DNA
cctgctctacctcctggagyagc

SEQ ID NO: 2839 - DNA, 23 bp, synthetic construct
  source 1..23: mol_type = other DNA
cctaggtatgttctyctacgtca

SEQ ID NO: 2840 - DNA, 23 bp, synthetic construct
  source 1..23: mol_type = other DNA
agtgtgrgccgccatcggcgagg

SEQ ID NO: 2841 - DNA, 23 bp, synthetic construct
  source 1..23: mol_type = other DNA
cccagcccttcaccctgygcctg

SEQ ID NO: 2842 - DNA, 23 bp, synthetic construct
  source 1..23: mol_type = other DNA
ccagcccttcaccctgygcctgg

SEQ ID NO: 2843 - DNA, 23 bp, synthetic construct
  source 1..23: mol_type = other DNA
caactgctrgagggaaggtgtgg

SEQ ID NO: 2844 - DNA, 23 bp, synthetic construct
  source 1..23: mol_type = other DNA
cagacctcrgcctgatgacctgg

SEQ ID NO: 2845 - DNA, 23 bp, synthetic construct
  source 1..23: mol_type = other DNA
catrgtaaggtgaaaatgcgagg

SEQ ID NO: 2846 - DNA, 23 bp, synthetic construct
  source 1..23: mol_type = other DNA
ccttaggcaaactcyttgacaag

SEQ ID NO: 2847 - DNA, 23 bp, synthetic construct
  source 1..23: mol_type = other DNA
atggrcgactggagctttctggg

SEQ ID NO: 2848 - DNA, 23 bp, synthetic construct
  source 1..23: mol_type = other DNA
aatggrcgactggagctttctgg

SEQ ID NO: 2849 - DNA, 23 bp, synthetic construct
  source 1..23: mol_type = other DNA
gcatggccrgggcgctgctgcgg

SEQ ID NO: 2850 - DNA, 23 bp, synthetic construct
  source 1..23: mol_type = other DNA
ccgctggccctgccycaacacgg

SEQ ID NO: 2851 - DNA, 23 bp, synthetic construct
  source 1..23: mol_type = other DNA
cctggggggatgagyaggctgat

SEQ ID NO: 2852 - DNA, 23 bp, synthetic construct
  source 1..23: mol_type = other DNA
ccggtggccctgccycaatgtgg

SEQ ID NO: 2853 - DNA, 23 bp, synthetic construct
  source 1..23: mol_type = other DNA
ggtgttccrgctgttgtttgagg

SEQ ID NO: 2854 - DNA, 23 bp, synthetic construct
  source 1..23: mol_type = other DNA
ccgggcctgtgcccgcygagccc

SEQ ID NO: 2855 - DNA, 23 bp, synthetic construct
  source 1..23: mol_type = other DNA
ccttcatctgcaacayactccag

SEQ ID NO: 2856 - DNA, 23 bp, synthetic construct
  source 1..23: mol_type = other DNA
ccgagtatggctctyggtcatct

SEQ ID NO: 2857 - DNA, 23 bp, synthetic construct
  source 1..23: mol_type = other DNA
ccctgaaagacatactgygccgc

SEQ ID NO: 2858 - DNA, 23 bp, synthetic construct
  source 1..23: mol_type = other DNA
cctgaaagacatactgygccgca

SEQ ID NO: 2859 - DNA, 23 bp, synthetic construct
  source 1..23: mol_type = other DNA
ccgctccaatccaccttccygca

SEQ ID NO: 2860 - DNA, 23 bp, synthetic construct
  source 1..23: mol_type = other DNA
ccaatccaccttccygcaagggc

SEQ ID NO: 2861 - DNA, 23 bp, synthetic construct
  source 1..23: mol_type = other DNA
ccccatctcccatgtgyggctgt

SEQ ID NO: 2862 - DNA, 23 bp, synthetic construct
  source 1..23: mol_type = other DNA
cccatctcccatgtgyggctgtg

SEQ ID NO: 2863 - DNA, 23 bp, synthetic construct
  source 1..23: mol_type = other DNA
ccatctcccatgtgyggctgtgg

SEQ ID NO: 2864 - DNA, 23 bp, synthetic construct
  source 1..23: mol_type = other DNA
gtctrcaacaccctgcagccagg

SEQ ID NO: 2865 - DNA, 23 bp, synthetic construct
  source 1..23: mol_type = other DNA
gcagrtgagcccgccggccccgg

SEQ ID NO: 2866 - DNA, 23 bp, synthetic construct
  source 1..23: mol_type = other DNA
ccccatctcccacatcyggctat

SEQ ID NO: 2867 - DNA, 23 bp, synthetic construct
  source 1..23: mol_type = other DNA
cccatctcccacatcyggctatg

SEQ ID NO: 2868 - DNA, 23 bp, synthetic construct
  source 1..23: mol_type = other DNA
ccatctcccacatcyggctatgg

SEQ ID NO: 2869 - DNA, 23 bp, synthetic construct
  source 1..23: mol_type = other DNA
cccggaagaagatgytgcttgtg

SEQ ID NO: 2870 - DNA, 23 bp, synthetic construct
  source 1..23: mol_type = other DNA
cccrtgtgccccgcttctactgg

SEQ ID NO: 2871 - DNA, 23 bp, synthetic construct
  source 1..23: mol_type = other DNA
ggccrctattggccagcccgggg

SEQ ID NO: 2872 - DNA, 23 bp, synthetic construct
  source 1..23: mol_type = other DNA
tggccrctattggccagcccggg

SEQ ID NO: 2873 - DNA, 23 bp, synthetic construct
  source 1..23: mol_type = other DNA
ttggccrctattggccagcccgg

SEQ ID NO: 2874 - DNA, 23 bp, synthetic construct
  source 1..23: mol_type = other DNA
actarggaggattacctgcttgg

SEQ ID NO: 2875 - DNA, 23 bp, synthetic construct
  source 1..23: mol_type = other DNA
cccccagggagtccttgagygaa

SEQ ID NO: 2876 - DNA, 23 bp, synthetic construct
  source 1..23: mol_type = other DNA
ccccagggagtccttgagygaaa

SEQ ID NO: 2877 - DNA, 23 bp, synthetic construct
  source 1..23: mol_type = other DNA
cccagggagtccttgagygaaac

SEQ ID NO: 2878 - DNA, 23 bp, synthetic construct
  source 1..23: mol_type = other DNA
ccagggagtccttgagygaaaca

SEQ ID NO: 2879 - DNA, 23 bp, synthetic construct
  source 1..23: mol_type = other DNA
cctgcagaagcgctttygccacc

SEQ ID NO: 2880 - DNA, 23 bp, synthetic construct
  source 1..23: mol_type = other DNA
ccgcttctactggaaggacyggc

SEQ ID NO: 2881 - DNA, 23 bp, synthetic construct
  source 1..23: mol_type = other DNA
tctgtcrccctggagacttcggg

SEQ ID NO: 2882 - DNA, 23 bp, synthetic construct
  source 1..23: mol_type = other DNA
atctgtcrccctggagacttcgg

SEQ ID NO: 2883 - DNA, 23 bp, synthetic construct
  source 1..23: mol_type = other DNA
cctgtgggaaccgtcagtgyggc

SEQ ID NO: 2884 - DNA, 23 bp, synthetic construct
  source 1..23: mol_type = other DNA
ccactgrgaagactgcaccaagg

SEQ ID NO: 2885 - DNA, 23 bp, synthetic construct
  source 1..23: mol_type = other DNA
ccccaacagacatctyagccaag

SEQ ID NO: 2886 - DNA, 23 bp, synthetic construct
  source 1..23: mol_type = other DNA
cccaacagacatctyagccaagc

SEQ ID NO: 2887 - DNA, 23 bp, synthetic construct
  source 1..23: mol_type = other DNA
ccgacctgcccattyagtggaac

SEQ ID NO: 2888 - DNA, 23 bp, synthetic construct
  source 1..23: mol_type = other DNA
atcccrcattggcttccccatgg

SEQ ID NO: 2889 - DNA, 23 bp, synthetic construct
  source 1..23: mol_type = other DNA
cctgtagacaggctgggcycatc

SEQ ID NO: 2890 - DNA, 23 bp, synthetic construct
  source 1..23: mol_type = other DNA
gaaagrctactacacatgcgtgg

SEQ ID NO: 2891 - DNA, 23 bp, synthetic construct
  source 1..23: mol_type = other DNA
atgaratatttacatcgttttgg

SEQ ID NO: 2892 - DNA, 23 bp, synthetic construct
  source 1..23: mol_type = other DNA
ccgttgaggtagagctcatyatt

SEQ ID NO: 2893 - DNA, 23 bp, synthetic construct
  source 1..23: mol_type = other DNA
ccttccagctgggaatcygaatc

SEQ ID NO: 2894 - DNA, 23 bp, synthetic construct
  source 1..23: mol_type = other DNA
ccgctgacgctgagcaccycgaa

SEQ ID NO: 2895 - DNA, 23 bp, synthetic construct
  source 1..23: mol_type = other DNA
ccctgcagtgctgcagygcatcc

SEQ ID NO: 2896 - DNA, 23 bp, synthetic construct
  source 1..23: mol_type = other DNA
cctgcagtgctgcagygcatcca

SEQ ID NO: 2897 - DNA, 23 bp, synthetic construct
  source 1..23: mol_type = other DNA
ccgcagcaccgtgcaccgcygga

SEQ ID NO: 2898 - DNA, 23 bp, synthetic construct
  source 1..23: mol_type = other DNA
ggacccrcgtaaagaccacgggg

SEQ ID NO: 2899 - DNA, 23 bp, synthetic construct
  source 1..23: mol_type = other DNA
cggacccrcgtaaagaccacggg

SEQ ID NO: 2900 - DNA, 23 bp, synthetic construct
  source 1..23: mol_type = other DNA
acggacccrcgtaaagaccacgg

SEQ ID NO: 2901 - DNA, 23 bp, synthetic construct
  source 1..23: mol_type = other DNA
tgaccatrtgaaaaaactttggg

SEQ ID NO: 2902 - DNA, 23 bp, synthetic construct
  source 1..23: mol_type = other DNA
ttgaccatrtgaaaaaactttgg

SEQ ID NO: 2903 - DNA, 23 bp, synthetic construct
  source 1..23: mol_type = other DNA
gagttcragtccccaccacaggg

SEQ ID NO: 2904 - DNA, 23 bp, synthetic construct
  source 1..23: mol_type = other DNA
agagttcragtccccaccacagg

SEQ ID NO: 2905 - DNA, 23 bp, synthetic construct
  source 1..23: mol_type = other DNA
cgctgccdtgtcctgacttctgg

SEQ ID NO: 2906 - DNA, 23 bp, synthetic construct
  source 1..23: mol_type = other DNA
ccatgagcaacctggtgcycccc

SEQ ID NO: 2907 - DNA, 23 bp, synthetic construct
  source 1..23: mol_type = other DNA
gatgrgcctgattgttcctgtgg

SEQ ID NO: 2908 - DNA, 23 bp, synthetic construct
  source 1..23: mol_type = other DNA
gtttcrcagcttggatgagatgg

SEQ ID NO: 2909 - DNA, 23 bp, synthetic construct
  source 1..23: mol_type = other DNA
cctttttcatgcggygtaccttt

SEQ ID NO: 2910 - DNA, 23 bp, synthetic construct
  source 1..23: mol_type = other DNA
tcctcrggtgagtggggccgggg

SEQ ID NO: 2911 - DNA, 23 bp, synthetic construct
  source 1..23: mol_type = other DNA
atcctcrggtgagtggggccggg

SEQ ID NO: 2912 - DNA, 23 bp, synthetic construct
  source 1..23: mol_type = other DNA
gatcctcrggtgagtggggccgg

SEQ ID NO: 2913 - DNA, 23 bp, synthetic construct
  source 1..23: mol_type = other DNA
cccgtgcatctcttcygactctc

SEQ ID NO: 2914 - DNA, 23 bp, synthetic construct
  source 1..23: mol_type = other DNA
ccgtgcatctcttcygactctcg

SEQ ID NO: 2915 - DNA, 23 bp, synthetic construct
  source 1..23: mol_type = other DNA
cctgcatcctccaccttcayggc

SEQ ID NO: 2916 - DNA, 23 bp, synthetic construct
  source 1..23: mol_type = other DNA
accrctccctggctatcacgagg

SEQ ID NO: 2917 - DNA, 23 bp, synthetic construct
  source 1..23: mol_type = other DNA
cccatgctttgatcyacttatct

SEQ ID NO: 2918 - DNA, 23 bp, synthetic construct
  source 1..23: mol_type = other DNA
ctgrctgctctttgcctctgtgg

SEQ ID NO: 2919 - DNA, 23 bp, synthetic construct
  source 1..23: mol_type = other DNA
cctgatgccttacactcgcytca

SEQ ID NO: 2920 - DNA, 23 bp, synthetic construct
  source 1..23: mol_type = other DNA
ttggcrgctccgacctggtgagg

SEQ ID NO: 2921 - DNA, 23 bp, synthetic construct
  source 1..23: mol_type = other DNA
ctcacracgcttctaccaatggg

SEQ ID NO: 2922 - DNA, 23 bp, synthetic construct
  source 1..23: mol_type = other DNA
tctcacracgcttctaccaatgg

SEQ ID NO: 2923 - DNA, 23 bp, synthetic construct
  source 1..23: mol_type = other DNA
ccatcacgaatgcagagayggcg

SEQ ID NO: 2924 - DNA, 23 bp, synthetic construct
  source 1..23: mol_type = other DNA
cccgccatggccgctctcayccg

SEQ ID NO: 2925 - DNA, 23 bp, synthetic construct
  source 1..23: mol_type = other DNA
ccgccatggccgctctcayccgg

SEQ ID NO: 2926 - DNA, 23 bp, synthetic construct
  source 1..23: mol_type = other DNA
ccatggccgctctcayccgggac

SEQ ID NO: 2927 - DNA, 23 bp, synthetic construct
  source 1..23: mol_type = other DNA
ccatttcctcggtgaatacytca

SEQ ID NO: 2928 - DNA, 23 bp, synthetic construct
  source 1..23: mol_type = other DNA
cccctgccctgaagaagygagtg

SEQ ID NO: 2929 - DNA, 23 bp, synthetic construct
  source 1..23: mol_type = other DNA
ccctgccctgaagaagygagtgt

SEQ ID NO: 2930 - DNA, 23 bp, synthetic construct
  source 1..23: mol_type = other DNA
cctgccctgaagaagygagtgtt

SEQ ID NO: 2931 - DNA, 23 bp, synthetic construct
  source 1..23: mol_type = other DNA
ccatagtttgttgtcagygacac

SEQ ID NO: 2932 - DNA, 23 bp, synthetic construct
  source 1..23: mol_type = other DNA
cctgcacgcccgataygctgagt

SEQ ID NO: 2933 - DNA, 23 bp, synthetic construct
  source 1..23: mol_type = other DNA
atcatcrggctggggcgcatagg

SEQ ID NO: 2934 - DNA, 23 bp, synthetic construct
  source 1..23: mol_type = other DNA
ctctagrccaggccattgctcgg

SEQ ID NO: 2935 - DNA, 23 bp, synthetic construct
  source 1..23: mol_type = other DNA
ccacccacagaaccygcaacacc

SEQ ID NO: 2936 - DNA, 23 bp, synthetic construct
  source 1..23: mol_type = other DNA
acttgtcrgaggtctggggctgg

SEQ ID NO: 2937 - DNA, 23 bp, synthetic construct
  source 1..23: mol_type = other DNA
tgaggaacrttctgaagtggtgg

SEQ ID NO: 2938 - DNA, 23 bp, synthetic construct
  source 1..23: mol_type = other DNA
tacctrtgcagaacccaaagggg

SEQ ID NO: 2939 - DNA, 23 bp, synthetic construct
  source 1..23: mol_type = other DNA
gtacctrtgcagaacccaaaggg

SEQ ID NO: 2940 - DNA, 23 bp, synthetic construct
  source 1..23: mol_type = other DNA
cgtacctrtgcagaacccaaagg

SEQ ID NO: 2941 - DNA, 23 bp, synthetic construct
  source 1..23: mol_type = other DNA
cccttcctcagagcyattcagcg

SEQ ID NO: 2942 - DNA, 23 bp, synthetic construct
  source 1..23: mol_type = other DNA
catrtggaccctggtgagctggg

SEQ ID NO: 2943 - DNA, 23 bp, synthetic construct
  source 1..23: mol_type = other DNA
ccatrtggaccctggtgagctgg

SEQ ID NO: 2944 - DNA, 23 bp, synthetic construct
  source 1..23: mol_type = other DNA
gcacacagrtaccagaggcaggg

SEQ ID NO: 2945 - DNA, 23 bp, synthetic construct
  source 1..23: mol_type = other DNA
ccgtgggtgccatcyagtgccct

SEQ ID NO: 2946 - DNA, 23 bp, synthetic construct
  source 1..23: mol_type = other DNA
cctgcaacgtgaaggctygatcc

SEQ ID NO: 2947 - DNA, 23 bp, synthetic construct
  source 1..23: mol_type = other DNA
ccaccagcactgctgyccccagg

SEQ ID NO: 2948 - DNA, 23 bp, synthetic construct
  source 1..23: mol_type = other DNA
cagcatctrgtgcggtaccgggg

SEQ ID NO: 2949 - DNA, 23 bp, synthetic construct
  source 1..23: mol_type = other DNA
tgtgcaccrgtgggtcccctggg

SEQ ID NO: 2950 - DNA, 23 bp, synthetic construct
  source 1..23: mol_type = other DNA
gagaatrgagatggtaagagggg

SEQ ID NO: 2951 - DNA, 23 bp, synthetic construct
  source 1..23: mol_type = other DNA
tgagaatrgagatggtaagaggg

SEQ ID NO: 2952 - DNA, 23 bp, synthetic construct
  source 1..23: mol_type = other DNA
atgagaatrgagatggtaagagg

SEQ ID NO: 2953 - DNA, 23 bp, synthetic construct
  source 1..23: mol_type = other DNA
ccgggagcrcacggaggagctgg

SEQ ID NO: 2954 - DNA, 23 bp, synthetic construct
  source 1..23: mol_type = other DNA
actcttgrtatcacgactacggg

SEQ ID NO: 2955 - DNA, 23 bp, synthetic construct
  source 1..23: mol_type = other DNA
tactcttgrtatcacgactacgg

SEQ ID NO: 2956 - DNA, 23 bp, synthetic construct
  source 1..23: mol_type = other DNA
gggcttcractggccgctgctgg

SEQ ID NO: 2957 - DNA, 23 bp, synthetic construct
  source 1..23: mol_type = other DNA
ccatactcrctctgaataatggg

SEQ ID NO: 2958 - DNA, 23 bp, synthetic construct
  source 1..23: mol_type = other DNA
ccatcaacaacacactcaycccc

SEQ ID NO: 2959 - DNA, 23 bp, synthetic construct
  source 1..23: mol_type = other DNA
ccatcaacaacacaytcaccccc

SEQ ID NO: 2960 - DNA, 23 bp, synthetic construct
  source 1..23: mol_type = other DNA
cctgaccaccatccgcygaatcg

SEQ ID NO: 2961 - DNA, 23 bp, synthetic construct
  source 1..23: mol_type = other DNA
ccaccggtactgcatggagygag

SEQ ID NO: 2962 - DNA, 23 bp, synthetic construct
  source 1..23: mol_type = other DNA
ccggtactgcatggagygagctt

SEQ ID NO: 2963 - DNA, 23 bp, synthetic construct
  source 1..23: mol_type = other DNA
gatgggcrccggcattgcccagg

SEQ ID NO: 2964 - DNA, 23 bp, synthetic construct
  source 1..23: mol_type = other DNA
ccggttaccccatgggccyattt

SEQ ID NO: 2965 - DNA, 23 bp, synthetic construct
  source 1..23: mol_type = other DNA
aacarattacggaaagaaggagg

SEQ ID NO: 2966 - DNA, 23 bp, synthetic construct
  source 1..23: mol_type = other DNA
gccaacarattacggaaagaagg

SEQ ID NO: 2967 - DNA, 23 bp, synthetic construct
  source 1..23: mol_type = other DNA
cccatgttccagaggygaaggag

SEQ ID NO: 2968 - DNA, 23 bp, synthetic construct
  source 1..23: mol_type = other DNA
ccatgttccagaggygaaggagg

SEQ ID NO: 2969 - DNA, 23 bp, synthetic construct
  source 1..23: mol_type = other DNA
ccagatcttgattccyaggtttc

SEQ ID NO: 2970 - DNA, 23 bp, synthetic construct
  source 1..23: mol_type = other DNA
ccactrcctgctggtgaccctgg

SEQ ID NO: 2971 - DNA, 23 bp, synthetic construct
  source 1..23: mol_type = other DNA
cctgtrgggcaaggtgaacgtgg

SEQ ID NO: 2972 - DNA, 23 bp, synthetic construct
  source 1..23: mol_type = other DNA
cctcaccctgtggagccayaccc

SEQ ID NO: 2973 - DNA, 23 bp, synthetic construct
  source 1..23: mol_type = other DNA
cctcaccctgtggagcyacaccc

SEQ ID NO: 2974 - DNA, 23 bp, synthetic construct
  source 1..23: mol_type = other DNA
cttraccaatagccttgacaagg

SEQ ID NO: 2975 - DNA, 23 bp, synthetic construct
  source 1..23: mol_type = other DNA
cctcttgggggccccttcyccac

SEQ ID NO: 2976 - DNA, 23 bp, synthetic construct
  source 1..23: mol_type = other DNA
ccagccttgccttgacyaatagc

SEQ ID NO: 2977 - DNA, 23 bp, synthetic construct
  source 1..23: mol_type = other DNA
ccccaaagtcaaggcayatggca

SEQ ID NO: 2978 - DNA, 23 bp, synthetic construct
  source 1..23: mol_type = other DNA
cccaaagtcaaggcayatggcaa

SEQ ID NO: 2979 - DNA, 23 bp, synthetic construct
  source 1..23: mol_type = other DNA
ccaaagtcaaggcayatggcaag

SEQ ID NO: 2980 - DNA, 23 bp, synthetic construct
  source 1..23: mol_type = other DNA
cccagctgagtgaactgyactgt

SEQ ID NO: 2981 - DNA, 23 bp, synthetic construct
  source 1..23: mol_type = other DNA
ccagctgagtgaactgyactgtg

SEQ ID NO: 2982 - DNA, 23 bp, synthetic construct
  source 1..23: mol_type = other DNA
cccaaggaagtcagcaycttctt

SEQ ID NO: 2983 - DNA, 23 bp, synthetic construct
  source 1..23: mol_type = other DNA
ccaaggaagtcagcaycttcttg

SEQ ID NO: 2984 - DNA, 23 bp, synthetic construct
  source 1..23: mol_type = other DNA
gaataacragcaggcttggaagg

SEQ ID NO: 2985 - DNA, 23 bp, synthetic construct
  source 1..23: mol_type = other DNA
gatgartggctgcaggctggggg

SEQ ID NO: 2986 - DNA, 23 bp, synthetic construct
  source 1..23: mol_type = other DNA
ggatgartggctgcaggctgggg

SEQ ID NO: 2987 - DNA, 23 bp, synthetic construct
  source 1..23: mol_type = other DNA
gggatgartggctgcaggctggg

SEQ ID NO: 2988 - DNA, 23 bp, synthetic construct
  source 1..23: mol_type = other DNA
cgggatgartggctgcaggctgg

SEQ ID NO: 2989 - DNA, 23 bp, synthetic construct
  source 1..23: mol_type = other DNA
ccagtggttcatcccagycgtga

SEQ ID NO: 2990 - DNA, 23 bp, synthetic construct
  source 1..23: mol_type = other DNA
acttgaccrgggtcatcctaggg

SEQ ID NO: 2991 - DNA, 23 bp, synthetic construct
  source 1..23: mol_type = other DNA
cctgactatcgagacygtatccg

SEQ ID NO: 2992 - DNA, 23 bp, synthetic construct
  source 1..23: mol_type = other DNA
tctagagraagacagaatccagg

SEQ ID NO: 2993 - DNA, 23 bp, synthetic construct
  source 1..23: mol_type = other DNA
accargtaagaatgatgtctggg

SEQ ID NO: 2994 - DNA, 23 bp, synthetic construct
  source 1..23: mol_type = other DNA
gaccargtaagaatgatgtctgg

SEQ ID NO: 2995 - DNA, 23 bp, synthetic construct
  source 1..23: mol_type = other DNA
tcctcaccrgggcttgctgttgg

SEQ ID NO: 2996 - DNA, 23 bp, synthetic construct
  source 1..23: mol_type = other DNA
accagrtaagaatgatgtctggg

SEQ ID NO: 2997 - DNA, 23 bp, synthetic construct
  source 1..23: mol_type = other DNA
gaccagrtaagaatgatgtctgg

SEQ ID NO: 2998 - DNA, 23 bp, synthetic construct
  source 1..23: mol_type = other DNA
gaacrtgttccactggcatctgg

SEQ ID NO: 2999 - DNA, 23 bp, synthetic construct
  source 1..23: mol_type = other DNA
cctgacatttgcctatgaaygtt

SEQ ID NO: 3000 - DNA, 23 bp, synthetic construct
  source 1..23: mol_type = other DNA
ccccgctttcctcacyggggctt

SEQ ID NO: 3001 - DNA, 23 bp, synthetic construct
  source 1..23: mol_type = other DNA
cccgctttcctcacyggggcttg

SEQ ID NO: 3002 - DNA, 23 bp, synthetic construct
  source 1..23: mol_type = other DNA
ccctccttccttcctcaygtctg

SEQ ID NO: 3003 - DNA, 23 bp, synthetic construct
  source 1..23: mol_type = other DNA
cctccttccttcctcaygtctgg

SEQ ID NO: 3004 - DNA, 23 bp, synthetic construct
  source 1..23: mol_type = other DNA
ccagggatacctaagcyaagaga

SEQ ID NO: 3005 - DNA, 23 bp, synthetic construct
  source 1..23: mol_type = other DNA
aggcctcrggcaagtgctgttgg

SEQ ID NO: 3006 - DNA, 23 bp, synthetic construct
  source 1..23: mol_type = other DNA
ccagattacgaggaattygagtc

SEQ ID NO: 3007 - DNA, 23 bp, synthetic construct
  source 1..23: mol_type = other DNA
acgtrccaggtggagcacccagg

SEQ ID NO: 3008 - DNA, 23 bp, synthetic construct
  source 1..23: mol_type = other DNA
ccaagtcaaagtaacaaacyata

SEQ ID NO: 3009 - DNA, 23 bp, synthetic construct
  source 1..23: mol_type = other DNA
tacartacatttctggatttggg

SEQ ID NO: 3010 - DNA, 23 bp, synthetic construct
  source 1..23: mol_type = other DNA
ctacartacatttctggatttgg

SEQ ID NO: 3011 - DNA, 23 bp, synthetic construct
  source 1..23: mol_type = other DNA
cctcgtgatttcttgatayccat

SEQ ID NO: 3012 - DNA, 23 bp, synthetic construct
  source 1..23: mol_type = other DNA
ctacrtaagcgaacccctggggg

SEQ ID NO: 3013 - DNA, 23 bp, synthetic construct
  source 1..23: mol_type = other DNA
cctacrtaagcgaacccctgggg

SEQ ID NO: 3014 - DNA, 23 bp, synthetic construct
  source 1..23: mol_type = other DNA
ccctacrtaagcgaacccctggg

SEQ ID NO: 3015 - DNA, 23 bp, synthetic construct
  source 1..23: mol_type = other DNA
gccctacrtaagcgaacccctgg

SEQ ID NO: 3016 - DNA, 23 bp, synthetic construct
  source 1..23: mol_type = other DNA
catcgtcrccactgccctctggg

SEQ ID NO: 3017 - DNA, 23 bp, synthetic construct
  source 1..23: mol_type = other DNA
acatcgtcrccactgccctctgg

SEQ ID NO: 3018 - DNA, 23 bp, synthetic construct
  source 1..23: mol_type = other DNA
ccattacaggggctcatttytgt

SEQ ID NO: 3019 - DNA, 23 bp, synthetic construct
  source 1..23: mol_type = other DNA
gaataaggrttatcgaatggtgg

SEQ ID NO: 3020 - DNA, 23 bp, synthetic construct
  source 1..23: mol_type = other DNA
cccaagaaacatatatccyagat

SEQ ID NO: 3021 - DNA, 23 bp, synthetic construct
  source 1..23: mol_type = other DNA
ccaagaaacatatatccyagatt

SEQ ID NO: 3022 - DNA, 23 bp, synthetic construct
  source 1..23: mol_type = other DNA
agtatcrgtaataaaggggaagg

SEQ ID NO: 3023 - DNA, 23 bp, synthetic construct
  source 1..23: mol_type = other DNA
tggctgtcrtggaagcagtgagg

SEQ ID NO: 3024 - DNA, 23 bp, synthetic construct
  source 1..23: mol_type = other DNA
cctgtgttccaggayggggaggg

SEQ ID NO: 3025 - DNA, 23 bp, synthetic construct
  source 1..23: mol_type = other DNA
caacacccrgcttcggaagctgg

SEQ ID NO: 3026 - DNA, 23 bp, synthetic construct
  source 1..23: mol_type = other DNA
tgggctrgcacaaccgggtgggg

SEQ ID NO: 3027 - DNA, 23 bp, synthetic construct
  source 1..23: mol_type = other DNA
atgggctrgcacaaccgggtggg

SEQ ID NO: 3028 - DNA, 23 bp, synthetic construct
  source 1..23: mol_type = other DNA
catgggctrgcacaaccgggtgg

SEQ ID NO: 3029 - DNA, 23 bp, synthetic construct
  source 1..23: mol_type = other DNA
ggtacccrcaagagccaggtggg

SEQ ID NO: 3030 - DNA, 23 bp, synthetic construct
  source 1..23: mol_type = other DNA
gggtacccrcaagagccaggtgg

SEQ ID NO: 3031 - DNA, 23 bp, synthetic construct
  source 1..23: mol_type = other DNA
gcagcttrctcgcatacagacgg

SEQ ID NO: 3032 - DNA, 23 bp, synthetic construct
  source 1..23: mol_type = other DNA
gggcgtgraagtgcgagccaagg

SEQ ID NO: 3033 - DNA, 23 bp, synthetic construct
  source 1..23: mol_type = other DNA
tcgctraaagggccttcctgagg

SEQ ID NO: 3034 - DNA, 23 bp, synthetic construct
  source 1..23: mol_type = other DNA
aaggrccttcctgaggcacctgg

SEQ ID NO: 3035 - DNA, 23 bp, synthetic construct
  source 1..23: mol_type = other DNA
tggrccaggtacacttgaccagg

SEQ ID NO: 3036 - DNA, 23 bp, synthetic construct
  source 1..23: mol_type = other DNA
ccttccctcctcccccaggyggg

SEQ ID NO: 3037 - DNA, 23 bp, synthetic construct
  source 1..23: mol_type = other DNA
ccctcctcccccaggygggaaaa

SEQ ID NO: 3038 - DNA, 23 bp, synthetic construct
  source 1..23: mol_type = other DNA
cctcctcccccaggygggaaaac

SEQ ID NO: 3039 - DNA, 23 bp, synthetic construct
  source 1..23: mol_type = other DNA
ccttagcaactctccacagyggg

SEQ ID NO: 3040 - DNA, 23 bp, synthetic construct
  source 1..23: mol_type = other DNA
ggacrtgggcatcctggccctgg

SEQ ID NO: 3041 - DNA, 23 bp, synthetic construct
  source 1..23: mol_type = other DNA
agcatcrccgaaagtatgcccgg

SEQ ID NO: 3042 - DNA, 23 bp, synthetic construct
  source 1..23: mol_type = other DNA
ggcrcaaagaagaagccttccgg

SEQ ID NO: 3043 - DNA, 23 bp, synthetic construct
  source 1..23: mol_type = other DNA
ccacagcgtcatcgagaycttca

SEQ ID NO: 3044 - DNA, 23 bp, synthetic construct
  source 1..23: mol_type = other DNA
ccctctcccagggaggaccygtg

SEQ ID NO: 3045 - DNA, 23 bp, synthetic construct
  source 1..23: mol_type = other DNA
cctctcccagggaggaccygtgg

SEQ ID NO: 3046 - DNA, 23 bp, synthetic construct
  source 1..23: mol_type = other DNA
agcrtgccgctctgtacacctgg

SEQ ID NO: 3047 - DNA, 23 bp, synthetic construct
  source 1..23: mol_type = other DNA
ccagaatgagcgggacyggatca

SEQ ID NO: 3048 - DNA, 23 bp, synthetic construct
  source 1..23: mol_type = other DNA
caacrgctggctctgagggcagg

SEQ ID NO: 3049 - DNA, 23 bp, synthetic construct
  source 1..23: mol_type = other DNA
ccagcaacrgctggctctgaggg

SEQ ID NO: 3050 - DNA, 23 bp, synthetic construct
  source 1..23: mol_type = other DNA
cccccctgtgaccacccycttca

SEQ ID NO: 3051 - DNA, 23 bp, synthetic construct
  source 1..23: mol_type = other DNA
ccccctgtgaccacccycttcac

SEQ ID NO: 3052 - DNA, 23 bp, synthetic construct
  source 1..23: mol_type = other DNA
cccctgtgaccacccycttcact

SEQ ID NO: 3053 - DNA, 23 bp, synthetic construct
  source 1..23: mol_type = other DNA
ccctgtgaccacccycttcactg

SEQ ID NO: 3054 - DNA, 23 bp, synthetic construct
  source 1..23: mol_type = other DNA
aatctgrttccagaacaggaggg

SEQ ID NO: 3055 - DNA, 23 bp, synthetic construct
  source 1..23: mol_type = other DNA
caatctgrttccagaacaggagg

SEQ ID NO: 3056 - DNA, 23 bp, synthetic construct
  source 1..23: mol_type = other DNA
cagcrcctcccagttctgagagg

SEQ ID NO: 3057 - DNA, 23 bp, synthetic construct
  source 1..23: mol_type = other DNA
gaaagrtatgtatcttgaaaggg

SEQ ID NO: 3058 - DNA, 23 bp, synthetic construct
  source 1..23: mol_type = other DNA
ggaaagrtatgtatcttgaaagg

SEQ ID NO: 3059 - DNA, 23 bp, synthetic construct
  source 1..23: mol_type = other DNA
ttaacarcttgctggtgaaaagg

SEQ ID NO: 3060 - DNA, 23 bp, synthetic construct
  source 1..23: mol_type = other DNA
ccatcacattgtagccytctgtg

SEQ ID NO: 3061 - DNA, 23 bp, synthetic construct
  source 1..23: mol_type = other DNA
ccagctggatcagagaycagacc

SEQ ID NO: 3062 - DNA, 23 bp, synthetic construct
  source 1..23: mol_type = other DNA
cctgcagtgtttcactgtgyggt

SEQ ID NO: 3063 - DNA, 23 bp, synthetic construct
  source 1..23: mol_type = other DNA
ccaaggtcctgcttcacygaaca

SEQ ID NO: 3064 - DNA, 23 bp, synthetic construct
  source 1..23: mol_type = other DNA
ggagggctrgccggccggccagg

SEQ ID NO: 3065 - DNA, 23 bp, synthetic construct
  source 1..23: mol_type = other DNA
gcccagrtgtgtacagccagtgg

SEQ ID NO: 3066 - DNA, 23 bp, synthetic construct
  source 1..23: mol_type = other DNA
ccgccgctrgtagtacccgcagg

SEQ ID NO: 3067 - DNA, 23 bp, synthetic construct
  source 1..23: mol_type = other DNA
ggccracctggtcagcatcctgg

SEQ ID NO: 3068 - DNA, 23 bp, synthetic construct
  source 1..23: mol_type = other DNA
cctcctgcccctgctgygcagct

SEQ ID NO: 3069 - DNA, 23 bp, synthetic construct
  source 1..23: mol_type = other DNA
ccttcaatgtgatcygcctggtg

SEQ ID NO: 3070 - DNA, 23 bp, synthetic construct
  source 1..23: mol_type = other DNA
ctggarcaggcgatggaattggg

SEQ ID NO: 3071 - DNA, 23 bp, synthetic construct
  source 1..23: mol_type = other DNA
actggarcaggcgatggaattgg

SEQ ID NO: 3072 - DNA, 23 bp, synthetic construct
  source 1..23: mol_type = other DNA
ccccatatgctgtctygactgca

SEQ ID NO: 3073 - DNA, 23 bp, synthetic construct
  source 1..23: mol_type = other DNA
cccatatgctgtctygactgcaa

SEQ ID NO: 3074 - DNA, 23 bp, synthetic construct
  source 1..23: mol_type = other DNA
aatgggtrgaatctaaaaaatgg

SEQ ID NO: 3075 - DNA, 23 bp, synthetic construct
  source 1..23: mol_type = other DNA
ccaacgagatcaccatccyagtc

SEQ ID NO: 3076 - DNA, 23 bp, synthetic construct
  source 1..23: mol_type = other DNA
ccaacgagatcaccatcycagtc

SEQ ID NO: 3077 - DNA, 23 bp, synthetic construct
  source 1..23: mol_type = other DNA
ccggcaagcacgaggagyggcag

SEQ ID NO: 3078 - DNA, 23 bp, synthetic construct
  source 1..23: mol_type = other DNA
cgctrcccgccaggctacatcgg

SEQ ID NO: 3079 - DNA, 23 bp, synthetic construct
  source 1..23: mol_type = other DNA
gctgcrgccgggagagttcgtgg

SEQ ID NO: 3080 - DNA, 23 bp, synthetic construct
  source 1..23: mol_type = other DNA
atcrtgagcaccacccagcgagg

SEQ ID NO: 3081 - DNA, 23 bp, synthetic construct
  source 1..23: mol_type = other DNA
cctcacggagtcccatgacygac

SEQ ID NO: 3082 - DNA, 23 bp, synthetic construct
  source 1..23: mol_type = other DNA
tgtggccraggcattccgtgtgg

SEQ ID NO: 3083 - DNA, 23 bp, synthetic construct
  source 1..23: mol_type = other DNA
tcatgrtcttatgttcttccagg

SEQ ID NO: 3084 - DNA, 23 bp, synthetic construct
  source 1..23: mol_type = other DNA
gaaacraccaacagctagtcagg

SEQ ID NO: 3085 - DNA, 23 bp, synthetic construct
  source 1..23: mol_type = other DNA
cataggtcrtcatgcttatgggg

SEQ ID NO: 3086 - DNA, 23 bp, synthetic construct
  source 1..23: mol_type = other DNA
ctatccrgaacatcctggggggg

SEQ ID NO: 3087 - DNA, 23 bp, synthetic construct
  source 1..23: mol_type = other DNA
actatccrgaacatcctgggggg

SEQ ID NO: 3088 - DNA, 23 bp, synthetic construct
  source 1..23: mol_type = other DNA
aactatccrgaacatcctggggg

SEQ ID NO: 3089 - DNA, 23 bp, synthetic construct
  source 1..23: mol_type = other DNA
ccatcattgcatttacctyggat

SEQ ID NO: 3090 - DNA, 23 bp, synthetic construct
  source 1..23: mol_type = other DNA
cctatagccagtatcccyggcct

SEQ ID NO: 3091 - DNA, 23 bp, synthetic construct
  source 1..23: mol_type = other DNA
gctctrggccgaagtgtcgcagg

SEQ ID NO: 3092 - DNA, 23 bp, synthetic construct
  source 1..23: mol_type = other DNA
gacgagrcggacccgctggtggg

SEQ ID NO: 3093 - DNA, 23 bp, synthetic construct
  source 1..23: mol_type = other DNA
cgacgagrcggacccgctggtgg

SEQ ID NO: 3094 - DNA, 23 bp, synthetic construct
  source 1..23: mol_type = other DNA
ccccttcgcgcagcgcaygctca

SEQ ID NO: 3095 - DNA, 23 bp, synthetic construct
  source 1..23: mol_type = other DNA
cccttcgcgcagcgcaygctcac

SEQ ID NO: 3096 - DNA, 23 bp, synthetic construct
  source 1..23: mol_type = other DNA
ccttcgcgcagcgcaygctcacc

SEQ ID NO: 3097 - DNA, 23 bp, synthetic construct
  source 1..23: mol_type = other DNA
ccacttgatctggtyggtgttca

SEQ ID NO: 3098 - DNA, 23 bp, synthetic construct
  source 1..23: mol_type = other DNA
tctcrtgatggccgtcggggagg

SEQ ID NO: 3099 - DNA, 23 bp, synthetic construct
  source 1..23: mol_type = other DNA
ccttctcrtgatggccgtcgggg

SEQ ID NO: 3100 - DNA, 23 bp, synthetic construct
  source 1..23: mol_type = other DNA
gccttctcrtgatggccgtcggg

SEQ ID NO: 3101 - DNA, 23 bp, synthetic construct
  source 1..23: mol_type = other DNA
ccaggagaccaggctggcgyagc

SEQ ID NO: 3102 - DNA, 23 bp, synthetic construct
  source 1..23: mol_type = other DNA
ccaagaagcagggattcycctca

SEQ ID NO: 3103 - DNA, 23 bp, synthetic construct
  source 1..23: mol_type = other DNA
ccaaagttcctcacygtccatca

SEQ ID NO: 3104 - DNA, 23 bp, synthetic construct
  source 1..23: mol_type = other DNA
gccatcccrcttccaggccaagg

SEQ ID NO: 3105 - DNA, 23 bp, synthetic construct
  source 1..23: mol_type = other DNA
ccagccacttgctgyagttgttg

SEQ ID NO: 3106 - DNA, 23 bp, synthetic construct
  source 1..23: mol_type = other DNA
ttcrtcagatccaacaggaaagg

SEQ ID NO: 3107 - DNA, 23 bp, synthetic construct
  source 1..23: mol_type = other DNA
tgtccttcrtcagatccaacagg

SEQ ID NO: 3108 - DNA, 23 bp, synthetic construct
  source 1..23: mol_type = other DNA
ccaggccccaacctcaggyagcg

SEQ ID NO: 3109 - DNA, 23 bp, synthetic construct
  source 1..23: mol_type = other DNA
accragggctgggacgaggacgg

SEQ ID NO: 3110 - DNA, 23 bp, synthetic construct
  source 1..23: mol_type = other DNA
ggtgaccragggctgggacgagg

SEQ ID NO: 3111 - DNA, 23 bp, synthetic construct
  source 1..23: mol_type = other DNA
cgccraccgcctcatgacccagg

SEQ ID NO: 3112 - DNA, 23 bp, synthetic construct
  source 1..23: mol_type = other DNA
gctgcrggtgaccgagggctggg

SEQ ID NO: 3113 - DNA, 23 bp, synthetic construct
  source 1..23: mol_type = other DNA
agctgcrggtgaccgagggctgg

SEQ ID NO: 3114 - DNA, 23 bp, synthetic construct
  source 1..23: mol_type = other DNA
ccgcgcggtggacatcaycacat

SEQ ID NO: 3115 - DNA, 23 bp, synthetic construct
  source 1..23: mol_type = other DNA
ccgccacgcaaactcgtgcygct

SEQ ID NO: 3116 - DNA, 23 bp, synthetic construct
  source 1..23: mol_type = other DNA
ccacgcaaactcgtgcygctcgc

SEQ ID NO: 3117 - DNA, 23 bp, synthetic construct
  source 1..23: mol_type = other DNA
ccacagtgtcctggctgagygac

SEQ ID NO: 3118 - DNA, 23 bp, synthetic construct
  source 1..23: mol_type = other DNA
cccaagtgccagtatyaggcccc

SEQ ID NO: 3119 - DNA, 23 bp, synthetic construct
  source 1..23: mol_type = other DNA
ccaagtgccagtatyaggcccct

SEQ ID NO: 3120 - DNA, 23 bp, synthetic construct
  source 1..23: mol_type = other DNA
cctccagctgtatgtgcggygcc

SEQ ID NO: 3121 - DNA, 23 bp, synthetic construct
  source 1..23: mol_type = other DNA
ccagctgtatgtgcggygccgaa

SEQ ID NO: 3122 - DNA, 23 bp, synthetic construct
  source 1..23: mol_type = other DNA
ccctgtcctatgaccttaycgca

SEQ ID NO: 3123 - DNA, 23 bp, synthetic construct
  source 1..23: mol_type = other DNA
cctgtcctatgaccttaycgcag

SEQ ID NO: 3124 - DNA, 23 bp, synthetic construct
  source 1..23: mol_type = other DNA
cctaggagctgatagcyagaggt

SEQ ID NO: 3125 - DNA, 23 bp, synthetic construct
  source 1..23: mol_type = other DNA
ccagtgagtgctgttttyaggac

SEQ ID NO: 3126 - DNA, 23 bp, synthetic construct
  source 1..23: mol_type = other DNA
cttccraggggtaccggttgggg

SEQ ID NO: 3127 - DNA, 23 bp, synthetic construct
  source 1..23: mol_type = other DNA
acttccraggggtaccggttggg

SEQ ID NO: 3128 - DNA, 23 bp, synthetic construct
  source 1..23: mol_type = other DNA
aacttccraggggtaccggttgg

SEQ ID NO: 3129 - DNA, 23 bp, synthetic construct
  source 1..23: mol_type = other DNA
ccctctctgcccgcagatcyagc

SEQ ID NO: 3130 - DNA, 23 bp, synthetic construct
  source 1..23: mol_type = other DNA
cctctctgcccgcagatcyagcc

SEQ ID NO: 3131 - DNA, 23 bp, synthetic construct
  source 1..23: mol_type = other DNA
gggctrgagcatctttgagctgg

SEQ ID NO: 3132 - DNA, 23 bp, synthetic construct
  source 1..23: mol_type = other DNA
ccctgtcaggacgatgcccygaa

SEQ ID NO: 3133 - DNA, 23 bp, synthetic construct
  source 1..23: mol_type = other DNA
cctgtcaggacgatgcccygaat

SEQ ID NO: 3134 - DNA, 23 bp, synthetic construct
  source 1..23: mol_type = other DNA
ccagttaaacctgaggctycttt

SEQ ID NO: 3135 - DNA, 23 bp, synthetic construct
  source 1..23: mol_type = other DNA
gggcrtcgacgtcatagtcttgg

SEQ ID NO: 3136 - DNA, 23 bp, synthetic construct
  source 1..23: mol_type = other DNA
ccaggccaacgaggtgyggaagg

SEQ ID NO: 3137 - DNA, 23 bp, synthetic construct
  source 1..23: mol_type = other DNA
cagctgcrgaacgagtttatcgg

SEQ ID NO: 3138 - DNA, 23 bp, synthetic construct
  source 1..23: mol_type = other DNA
agcrgctgctggactacaccagg

SEQ ID NO: 3139 - DNA, 23 bp, synthetic construct
  source 1..23: mol_type = other DNA
ccagacctctcaccatcacygcc

SEQ ID NO: 3140 - DNA, 23 bp, synthetic construct
  source 1..23: mol_type = other DNA
cctctcaccatcacygccaccac

SEQ ID NO: 3141 - DNA, 23 bp, synthetic construct
  source 1..23: mol_type = other DNA
cctgrcagcgagaaactgcatgg

SEQ ID NO: 3142 - DNA, 23 bp, synthetic construct
  source 1..23: mol_type = other DNA
tatcgactrgtcccgtatcctgg

SEQ ID NO: 3143 - DNA, 23 bp, synthetic construct
  source 1..23: mol_type = other DNA
tactaccrgaaagggggcaaggg

SEQ ID NO: 3144 - DNA, 23 bp, synthetic construct
  source 1..23: mol_type = other DNA
ttactaccrgaaagggggcaagg

SEQ ID NO: 3145 - DNA, 23 bp, synthetic construct
  source 1..23: mol_type = other DNA
ccctgtacrgtggatggcaccgg

SEQ ID NO: 3146 - DNA, 23 bp, synthetic construct
  source 1..23: mol_type = other DNA
gtacrtgccggacgagtgggagg

SEQ ID NO: 3147 - DNA, 23 bp, synthetic construct
  source 1..23: mol_type = other DNA
tgtgtacrtgccggacgagtggg

SEQ ID NO: 3148 - DNA, 23 bp, synthetic construct
  source 1..23: mol_type = other DNA
ctgtgtacrtgccggacgagtgg

SEQ ID NO: 3149 - DNA, 23 bp, synthetic construct
  source 1..23: mol_type = other DNA
ccaagaaacaaagtgacayaagc

SEQ ID NO: 3150 - DNA, 23 bp, synthetic construct
  source 1..23: mol_type = other DNA
ccgagttgaactgaagaaaygag

SEQ ID NO: 3151 - DNA, 23 bp, synthetic construct
  source 1..23: mol_type = other DNA
ccatgagactttccygagaattg

SEQ ID NO: 3152 - DNA, 23 bp, synthetic construct
  source 1..23: mol_type = other DNA
gatgagtcrctccactttctggg

SEQ ID NO: 3153 - DNA, 23 bp, synthetic construct
  source 1..23: mol_type = other DNA
cctcctgccctgcagccagyggt

SEQ ID NO: 3154 - DNA, 23 bp, synthetic construct
  source 1..23: mol_type = other DNA
cctgccctgcagccagyggtact

SEQ ID NO: 3155 - DNA, 23 bp, synthetic construct
  source 1..23: mol_type = other DNA
ccatccagacagccttcygccag

SEQ ID NO: 3156 - DNA, 23 bp, synthetic construct
  source 1..23: mol_type = other DNA
ccatcaacatatgtgygctgcct

SEQ ID NO: 3157 - DNA, 23 bp, synthetic construct
  source 1..23: mol_type = other DNA
atgrccagatgggaaaccattgg

SEQ ID NO: 3158 - DNA, 23 bp, synthetic construct
  source 1..23: mol_type = other DNA
ccacccggcatagccctyaacaa

SEQ ID NO: 3159 - DNA, 23 bp, synthetic construct
  source 1..23: mol_type = other DNA
cccggcatagccctyaacaagaa

SEQ ID NO: 3160 - DNA, 23 bp, synthetic construct
  source 1..23: mol_type = other DNA
cccccccagatcatggycctcca

SEQ ID NO: 3161 - DNA, 23 bp, synthetic construct
  source 1..23: mol_type = other DNA
ccccccagatcatggycctccac

SEQ ID NO: 3162 - DNA, 23 bp, synthetic construct
  source 1..23: mol_type = other DNA
cccccagatcatggycctccacc

SEQ ID NO: 3163 - DNA, 23 bp, synthetic construct
  source 1..23: mol_type = other DNA
cctgaacaggtcattycagtagt

SEQ ID NO: 3164 - DNA, 23 bp, synthetic construct
  source 1..23: mol_type = other DNA
ccgcctgcagatctyaaccccag

SEQ ID NO: 3165 - DNA, 23 bp, synthetic construct
  source 1..23: mol_type = other DNA
cccgagcggtgtggcgctgyagg

SEQ ID NO: 3166 - DNA, 23 bp, synthetic construct
  source 1..23: mol_type = other DNA
ccgagcggtgtggcgctgyagga

SEQ ID NO: 3167 - DNA, 23 bp, synthetic construct
  source 1..23: mol_type = other DNA
ctcrtttgtaggtcacctaaagg

SEQ ID NO: 3168 - DNA, 23 bp, synthetic construct
  source 1..23: mol_type = other DNA
ggccgtggrcgagttcgacgggg

SEQ ID NO: 3169 - DNA, 23 bp, synthetic construct
  source 1..23: mol_type = other DNA
ccaccatggccttccttygagta

SEQ ID NO: 3170 - DNA, 23 bp, synthetic construct
  source 1..23: mol_type = other DNA
ccatggccttccttygagtacgc

SEQ ID NO: 3171 - DNA, 23 bp, synthetic construct
  source 1..23: mol_type = other DNA
ccggccccgcctggcttaygtgg

SEQ ID NO: 3172 - DNA, 23 bp, synthetic construct
  source 1..23: mol_type = other DNA
ccccgcctggcttaygtggccaa

SEQ ID NO: 3173 - DNA, 23 bp, synthetic construct
  source 1..23: mol_type = other DNA
cctgcaaaaggcactcygatggc

SEQ ID NO: 3174 - DNA, 23 bp, synthetic construct
  source 1..23: mol_type = other DNA
gccrgtggggacagaacaaaagg

SEQ ID NO: 3175 - DNA, 23 bp, synthetic construct
  source 1..23: mol_type = other DNA
cgacrgccgctgtcacctggagg

SEQ ID NO: 3176 - DNA, 23 bp, synthetic construct
  source 1..23: mol_type = other DNA
caacgacrgccgctgtcacctgg

SEQ ID NO: 3177 - DNA, 23 bp, synthetic construct
  source 1..23: mol_type = other DNA
tgccacctrcctcaacaatgagg

SEQ ID NO: 3178 - DNA, 23 bp, synthetic construct
  source 1..23: mol_type = other DNA
ccgggrcatggtggagttccagg

SEQ ID NO: 3179 - DNA, 23 bp, synthetic construct
  source 1..23: mol_type = other DNA
ccggcgctrcaacacccaggcgg

SEQ ID NO: 3180 - DNA, 23 bp, synthetic construct
  source 1..23: mol_type = other DNA
ccctctctgcagacygaggacgc

SEQ ID NO: 3181 - DNA, 23 bp, synthetic construct
  source 1..23: mol_type = other DNA
cctggtgactcgactcyggtatc

SEQ ID NO: 3182 - DNA, 23 bp, synthetic construct
  source 1..23: mol_type = other DNA
gattcctgrtaagtagcaccggg

SEQ ID NO: 3183 - DNA, 23 bp, synthetic construct
  source 1..23: mol_type = other DNA
cctgcacgtgagggaagyctttg

SEQ ID NO: 3184 - DNA, 23 bp, synthetic construct
  source 1..23: mol_type = other DNA
acgrcatctgtaatgagccctgg

SEQ ID NO: 3185 - DNA, 23 bp, synthetic construct
  source 1..23: mol_type = other DNA
ccactttgagtatcagatcygcg

SEQ ID NO: 3186 - DNA, 23 bp, synthetic construct
  source 1..23: mol_type = other DNA
ggcacaatrgcgtctcgagcagg

SEQ ID NO: 3187 - DNA, 23 bp, synthetic construct
  source 1..23: mol_type = other DNA
ccttctggttggcctcagcygac

SEQ ID NO: 3188 - DNA, 23 bp, synthetic construct
  source 1..23: mol_type = other DNA
ccartaagtgtcagggagccggg

SEQ ID NO: 3189 - DNA, 23 bp, synthetic construct
  source 1..23: mol_type = other DNA
gccartaagtgtcagggagccgg

SEQ ID NO: 3190 - DNA, 23 bp, synthetic construct
  source 1..23: mol_type = other DNA
tcacratctcatggaaatcacgg

SEQ ID NO: 3191 - DNA, 23 bp, synthetic construct
  source 1..23: mol_type = other DNA
ccatcaacgacctgtyggtggtg

SEQ ID NO: 3192 - DNA, 23 bp, synthetic construct
  source 1..23: mol_type = other DNA
tccrgttggtaagagtctttagg

SEQ ID NO: 3193 - DNA, 23 bp, synthetic construct
  source 1..23: mol_type = other DNA
ccggraaacagatttgtgaaagg

SEQ ID NO: 3194 - DNA, 23 bp, synthetic construct
  source 1..23: mol_type = other DNA
gtccratgcctggcaagagaagg

SEQ ID NO: 3195 - DNA, 23 bp, synthetic construct
  source 1..23: mol_type = other DNA
tctacatcragtccgatgcctgg

SEQ ID NO: 3196 - DNA, 23 bp, synthetic construct
  source 1..23: mol_type = other DNA
ttcttcrgcttcttcaccctggg

SEQ ID NO: 3197 - DNA, 23 bp, synthetic construct
  source 1..23: mol_type = other DNA
attcttcrgcttcttcaccctgg

SEQ ID NO: 3198 - DNA, 23 bp, synthetic construct
  source 1..23: mol_type = other DNA
ccagcttcttggagyggatgtag

SEQ ID NO: 3199 - DNA, 23 bp, synthetic construct
  source 1..23: mol_type = other DNA
ccaagaagctggagcactygaac

SEQ ID NO: 3200 - DNA, 23 bp, synthetic construct
  source 1..23: mol_type = other DNA
cctgtctaacaccayagcggtga

SEQ ID NO: 3201 - DNA, 23 bp, synthetic construct
  source 1..23: mol_type = other DNA
ccatgagaacattggtgyggctg

SEQ ID NO: 3202 - DNA, 23 bp, synthetic construct
  source 1..23: mol_type = other DNA
ccaatttcacacagaygctggaa

SEQ ID NO: 3203 - DNA, 23 bp, synthetic construct
  source 1..23: mol_type = other DNA
tgaatatrgagctgctgtgctgg

SEQ ID NO: 3204 - DNA, 23 bp, synthetic construct
  source 1..23: mol_type = other DNA
ccggccgrgggggccgtgggggg

SEQ ID NO: 3205 - DNA, 23 bp, synthetic construct
  source 1..23: mol_type = other DNA
gccggccgrgggggccgtggggg

SEQ ID NO: 3206 - DNA, 23 bp, synthetic construct
  source 1..23: mol_type = other DNA
agcttctrgggggacagtcgggg

SEQ ID NO: 3207 - DNA, 23 bp, synthetic construct
  source 1..23: mol_type = other DNA
cagcttctrgggggacagtcggg

SEQ ID NO: 3208 - DNA, 23 bp, synthetic construct
  source 1..23: mol_type = other DNA
cgggtgcargtcctgtccctggg

SEQ ID NO: 3209 - DNA, 23 bp, synthetic construct
  source 1..23: mol_type = other DNA
gctrtgagtgtgcccaggggcgg

SEQ ID NO: 3210 - DNA, 23 bp, synthetic construct
  source 1..23: mol_type = other DNA
ttggctrtgagtgtgcccagggg

SEQ ID NO: 3211 - DNA, 23 bp, synthetic construct
  source 1..23: mol_type = other DNA
attggctrtgagtgtgcccaggg

SEQ ID NO: 3212 - DNA, 23 bp, synthetic construct
  source 1..23: mol_type = other DNA
cattggctrtgagtgtgcccagg

SEQ ID NO: 3213 - DNA, 23 bp, synthetic construct
  source 1..23: mol_type = other DNA
ggcrgagggggctggagctgcgg

SEQ ID NO: 3214 - DNA, 23 bp, synthetic construct
  source 1..23: mol_type = other DNA
catcraggccatgcgcgccgggg

SEQ ID NO: 3215 - DNA, 23 bp, synthetic construct
  source 1..23: mol_type = other DNA
acatcraggccatgcgcgccggg

SEQ ID NO: 3216 - DNA, 23 bp, synthetic construct
  source 1..23: mol_type = other DNA
gacatcraggccatgcgcgccgg

SEQ ID NO: 3217 - DNA, 23 bp, synthetic construct
  source 1..23: mol_type = other DNA
cctgggcgdcccctccatcaagg

SEQ ID NO: 3218 - DNA, 23 bp, synthetic construct
  source 1..23: mol_type = other DNA
cagtcrgggccgccagtaccagg

SEQ ID NO: 3219 - DNA, 23 bp, synthetic construct
  source 1..23: mol_type = other DNA
cccgggrcgacgtggagagcagg

SEQ ID NO: 3220 - DNA, 23 bp, synthetic construct
  source 1..23: mol_type = other DNA
agcrcaagttgtccttccgcagg

SEQ ID NO: 3221 - DNA, 23 bp, synthetic construct
  source 1..23: mol_type = other DNA
ctccarccctgagagcagtgagg

SEQ ID NO: 3222 - DNA, 23 bp, synthetic construct
  source 1..23: mol_type = other DNA
ccargggaggtgtcggccttggg

SEQ ID NO: 3223 - DNA, 23 bp, synthetic construct
  source 1..23: mol_type = other DNA
gccargggaggtgtcggccttgg

SEQ ID NO: 3224 - DNA, 23 bp, synthetic construct
  source 1..23: mol_type = other DNA
gtagccrgggccggccggggggg

SEQ ID NO: 3225 - DNA, 23 bp, synthetic construct
  source 1..23: mol_type = other DNA
agtagccrgggccggccgggggg

SEQ ID NO: 3226 - DNA, 23 bp, synthetic construct
  source 1..23: mol_type = other DNA
gagtagccrgggccggccggggg

SEQ ID NO: 3227 - DNA, 23 bp, synthetic construct
  source 1..23: mol_type = other DNA
agcttctgrggggacagtcgggg

SEQ ID NO: 3228 - DNA, 23 bp, synthetic construct
  source 1..23: mol_type = other DNA
gtcgccccrcaggatctcgatgg

SEQ ID NO: 3229 - DNA, 23 bp, synthetic construct
  source 1..23: mol_type = other DNA
ccggccgctgggcgcctacytgg

SEQ ID NO: 3230 - DNA, 23 bp, synthetic construct
  source 1..23: mol_type = other DNA
ccgctgggcgcctacytgggtga

SEQ ID NO: 3231 - DNA, 23 bp, synthetic construct
  source 1..23: mol_type = other DNA
cccgctaccacacayagatgctg

SEQ ID NO: 3232 - DNA, 23 bp, synthetic construct
  source 1..23: mol_type = other DNA
ccagtaccaggagctccctygat

SEQ ID NO: 3233 - DNA, 23 bp, synthetic construct
  source 1..23: mol_type = other DNA
cctaagataaaggagygaaccca

SEQ ID NO: 3234 - DNA, 23 bp, synthetic construct
  source 1..23: mol_type = other DNA
cctttgcgctcatcgcgyactgg

SEQ ID NO: 3235 - DNA, 23 bp, synthetic construct
  source 1..23: mol_type = other DNA
ccatgcacccactgygcagcggc

SEQ ID NO: 3236 - DNA, 23 bp, synthetic construct
  source 1..23: mol_type = other DNA
ccttcctgctgaaggagayggaa

SEQ ID NO: 3237 - DNA, 23 bp, synthetic construct
  source 1..23: mol_type = other DNA
cctgctgaaggagayggaagaag

SEQ ID NO: 3238 - DNA, 23 bp, synthetic construct
  source 1..23: mol_type = other DNA
ccccggccgcatcgccgtcyact

SEQ ID NO: 3239 - DNA, 23 bp, synthetic construct
  source 1..23: mol_type = other DNA
cccggccgcatcgccgtcyacta

SEQ ID NO: 3240 - DNA, 23 bp, synthetic construct
  source 1..23: mol_type = other DNA
ccggccgcatcgccgtcyactac

SEQ ID NO: 3241 - DNA, 23 bp, synthetic construct
  source 1..23: mol_type = other DNA
ccccaatcccctgcgccagygcc

SEQ ID NO: 3242 - DNA, 23 bp, synthetic construct
  source 1..23: mol_type = other DNA
cccaatcccctgcgccagygcct

SEQ ID NO: 3243 - DNA, 23 bp, synthetic construct
  source 1..23: mol_type = other DNA
ccaatcccctgcgccagygcctc

SEQ ID NO: 3244 - DNA, 23 bp, synthetic construct
  source 1..23: mol_type = other DNA
cctctccagcccgggtcggyggc

SEQ ID NO: 3245 - DNA, 23 bp, synthetic construct
  source 1..23: mol_type = other DNA
ccagcccgggtcggyggccccgg

SEQ ID NO: 3246 - DNA, 23 bp, synthetic construct
  source 1..23: mol_type = other DNA
cccagcccctgcacagayacggc

SEQ ID NO: 3247 - DNA, 23 bp, synthetic construct
  source 1..23: mol_type = other DNA
ccagcccctgcacagayacggct

SEQ ID NO: 3248 - DNA, 23 bp, synthetic construct
  source 1..23: mol_type = other DNA
cctttgcgctcatcgygcactgg

SEQ ID NO: 3249 - DNA, 23 bp, synthetic construct
  source 1..23: mol_type = other DNA
ccacacatggactcaygcatcgg

SEQ ID NO: 3250 - DNA, 23 bp, synthetic construct
  source 1..23: mol_type = other DNA
cctcgaggagtacttcyagcacg

SEQ ID NO: 3251 - DNA, 23 bp, synthetic construct
  source 1..23: mol_type = other DNA
ccccatcctcgttcttcaygggc

SEQ ID NO: 3252 - DNA, 23 bp, synthetic construct
  source 1..23: mol_type = other DNA
cccatcctcgttcttcaygggca

SEQ ID NO: 3253 - DNA, 23 bp, synthetic construct
  source 1..23: mol_type = other DNA
ccatcctcgttcttcaygggcac

SEQ ID NO: 3254 - DNA, 23 bp, synthetic construct
  source 1..23: mol_type = other DNA
ccttggggccgggccgggygggg

SEQ ID NO: 3255 - DNA, 23 bp, synthetic construct
  source 1..23: mol_type = other DNA
aacrcagtgatcagcaaacgggg

SEQ ID NO: 3256 - DNA, 23 bp, synthetic construct
  source 1..23: mol_type = other DNA
gaacrcagtgatcagcaaacggg

SEQ ID NO: 3257 - DNA, 23 bp, synthetic construct
  source 1..23: mol_type = other DNA
agaacrcagtgatcagcaaacgg

SEQ ID NO: 3258 - DNA, 23 bp, synthetic construct
  source 1..23: mol_type = other DNA
ccctgcctcatgatcygagttgc

SEQ ID NO: 3259 - DNA, 23 bp, synthetic construct
  source 1..23: mol_type = other DNA
cctgcctcatgatcygagttgcc

SEQ ID NO: 3260 - DNA, 23 bp, synthetic construct
  source 1..23: mol_type = other DNA
ccacctgtcaggtgygcacttcc

SEQ ID NO: 3261 - DNA, 23 bp, synthetic construct
  source 1..23: mol_type = other DNA
cctccgtgacagcactgtaygct

SEQ ID NO: 3262 - DNA, 23 bp, synthetic construct
  source 1..23: mol_type = other DNA
ccgtgacagcactgtaygctacg

SEQ ID NO: 3263 - DNA, 23 bp, synthetic construct
  source 1..23: mol_type = other DNA
ggagcaggrccgcttcctgcagg

SEQ ID NO: 3264 - DNA, 23 bp, synthetic construct
  source 1..23: mol_type = other DNA
ggacrtgttcaccacgctggtgg

SEQ ID NO: 3265 - DNA, 23 bp, synthetic construct
  source 1..23: mol_type = other DNA
gcaggacrtgttcaccacgctgg

SEQ ID NO: 3266 - DNA, 23 bp, synthetic construct
  source 1..23: mol_type = other DNA
cctcragatcatcgtcatcctgg

SEQ ID NO: 3267 - DNA, 23 bp, synthetic construct
  source 1..23: mol_type = other DNA
ccgcctctgcttcatgctaygtg

SEQ ID NO: 3268 - DNA, 23 bp, synthetic construct
  source 1..23: mol_type = other DNA
cctctgcttcatgctaygtgtgg

SEQ ID NO: 3269 - DNA, 23 bp, synthetic construct
  source 1..23: mol_type = other DNA
cctcttctccatcgagaygcaga

SEQ ID NO: 3270 - DNA, 23 bp, synthetic construct
  source 1..23: mol_type = other DNA
ccgggatggcctcagccccyagg

SEQ ID NO: 3271 - DNA, 23 bp, synthetic construct
  source 1..23: mol_type = other DNA
cctatgaggtgccctctaygccc

SEQ ID NO: 3272 - DNA, 23 bp, synthetic construct
  source 1..23: mol_type = other DNA
atcatcratgctttcatcattgg

SEQ ID NO: 3273 - DNA, 23 bp, synthetic construct
  source 1..23: mol_type = other DNA
ccaagatggcaaagcyaaagaag

SEQ ID NO: 3274 - DNA, 23 bp, synthetic construct
  source 1..23: mol_type = other DNA
caccattrgttatggctaccggg

SEQ ID NO: 3275 - DNA, 23 bp, synthetic construct
  source 1..23: mol_type = other DNA
ccaccattrgttatggctaccgg

SEQ ID NO: 3276 - DNA, 23 bp, synthetic construct
  source 1..23: mol_type = other DNA
catcrgggccttcctcaacctgg

SEQ ID NO: 3277 - DNA, 23 bp, synthetic construct
  source 1..23: mol_type = other DNA
aggagrtgggcacggccaaacgg

SEQ ID NO: 3278 - DNA, 23 bp, synthetic construct
  source 1..23: mol_type = other DNA
gacaargtaggctcacgcgccgg

SEQ ID NO: 3279 - DNA, 23 bp, synthetic construct
  source 1..23: mol_type = other DNA
tcctcragcgtcccaccggctgg

SEQ ID NO: 3280 - DNA, 23 bp, synthetic construct
  source 1..23: mol_type = other DNA
ctgraagatctacatccggaagg

SEQ ID NO: 3281 - DNA, 23 bp, synthetic construct
  source 1..23: mol_type = other DNA
ccacctgraagatctacatccgg

SEQ ID NO: 3282 - DNA, 23 bp, synthetic construct
  source 1..23: mol_type = other DNA
ctgcrtgggctccaaggggcagg

SEQ ID NO: 3283 - DNA, 23 bp, synthetic construct
  source 1..23: mol_type = other DNA
tcctctgcrtgggctccaagggg

SEQ ID NO: 3284 - DNA, 23 bp, synthetic construct
  source 1..23: mol_type = other DNA
cccaggrgattcttggctcgggg

SEQ ID NO: 3285 - DNA, 23 bp, synthetic construct
  source 1..23: mol_type = other DNA
tcccaggrgattcttggctcggg

SEQ ID NO: 3286 - DNA, 23 bp, synthetic construct
  source 1..23: mol_type = other DNA
ttcccaggrgattcttggctcgg

SEQ ID NO: 3287 - DNA, 23 bp, synthetic construct
  source 1..23: mol_type = other DNA
tacrcagatgcgctgtggtgggg

SEQ ID NO: 3288 - DNA, 23 bp, synthetic construct
  source 1..23: mol_type = other DNA
ctacrcagatgcgctgtggtggg

SEQ ID NO: 3289 - DNA, 23 bp, synthetic construct
  source 1..23: mol_type = other DNA
gctacrcagatgcgctgtggtgg

SEQ ID NO: 3290 - DNA, 23 bp, synthetic construct
  source 1..23: mol_type = other DNA
gcagctacrcagatgcgctgtgg

SEQ ID NO: 3291 - DNA, 23 bp, synthetic construct
  source 1..23: mol_type = other DNA
tgtgrccaagaagaaattccagg

SEQ ID NO: 3292 - DNA, 23 bp, synthetic construct
  source 1..23: mol_type = other DNA
catcragcagtatgccgccctgg

SEQ ID NO: 3293 - DNA, 23 bp, synthetic construct
  source 1..23: mol_type = other DNA
atcrtgctggtggtgttcttcgg

SEQ ID NO: 3294 - DNA, 23 bp, synthetic construct
  source 1..23: mol_type = other DNA
cggagtacrtggtccgcctctgg

SEQ ID NO: 3295 - DNA, 23 bp, synthetic construct
  source 1..23: mol_type = other DNA
gagtcagrccgcgtggagttcgg

SEQ ID NO: 3296 - DNA, 23 bp, synthetic construct
  source 1..23: mol_type = other DNA
gatcgcrgcagcaacacgatcgg

SEQ ID NO: 3297 - DNA, 23 bp, synthetic construct
  source 1..23: mol_type = other DNA
ggtgaacragtcaggccgcgtgg

SEQ ID NO: 3298 - DNA, 23 bp, synthetic construct
  source 1..23: mol_type = other DNA
gatcrcggcagcaacacgatcgg

SEQ ID NO: 3299 - DNA, 23 bp, synthetic construct
  source 1..23: mol_type = other DNA
ggatgrtacgtagcatctgaggg

SEQ ID NO: 3300 - DNA, 23 bp, synthetic construct
  source 1..23: mol_type = other DNA
tggatgrtacgtagcatctgagg

SEQ ID NO: 3301 - DNA, 23 bp, synthetic construct
  source 1..23: mol_type = other DNA
catcrtggtcgtggcctccatgg

SEQ ID NO: 3302 - DNA, 23 bp, synthetic construct
  source 1..23: mol_type = other DNA
cgtgcraccccccagaagagcgg

SEQ ID NO: 3303 - DNA, 23 bp, synthetic construct
  source 1..23: mol_type = other DNA
cccagcgrtaggtgccccgtggg

SEQ ID NO: 3304 - DNA, 23 bp, synthetic construct
  source 1..23: mol_type = other DNA
tcccagcgrtaggtgccccgtgg

SEQ ID NO: 3305 - DNA, 23 bp, synthetic construct
  source 1..23: mol_type = other DNA
ccccccagaagagcggyggctgg

SEQ ID NO: 3306 - DNA, 23 bp, synthetic construct
  source 1..23: mol_type = other DNA
cccccagaagagcggyggctgga

SEQ ID NO: 3307 - DNA, 23 bp, synthetic construct
  source 1..23: mol_type = other DNA
ccccagaagagcggyggctggac

SEQ ID NO: 3308 - DNA, 23 bp, synthetic construct
  source 1..23: mol_type = other DNA
ccattaaggtcattcgaygcatg

SEQ ID NO: 3309 - DNA, 23 bp, synthetic construct
  source 1..23: mol_type = other DNA
cccgcgccccctgcgtycccggc

SEQ ID NO: 3310 - DNA, 23 bp, synthetic construct
  source 1..23: mol_type = other DNA
ccgcgccccctgcgtycccggcc

SEQ ID NO: 3311 - DNA, 23 bp, synthetic construct
  source 1..23: mol_type = other DNA
cctcatcgtcctggtctgcytca

SEQ ID NO: 3312 - DNA, 23 bp, synthetic construct
  source 1..23: mol_type = other DNA
cctccatggtggtcctctghgtg

SEQ ID NO: 3313 - DNA, 23 bp, synthetic construct
  source 1..23: mol_type = other DNA
ccatggtggtcctctghgtgggc

SEQ ID NO: 3314 - DNA, 23 bp, synthetic construct
  source 1..23: mol_type = other DNA
cctgaaggtgcagcagaagyaga

SEQ ID NO: 3315 - DNA, 23 bp, synthetic construct
  source 1..23: mol_type = other DNA
ccaagaagaaattcyaggtaagc

SEQ ID NO: 3316 - DNA, 23 bp, synthetic construct
  source 1..23: mol_type = other DNA
cccggcarcaggcctgatccagg

SEQ ID NO: 3317 - DNA, 23 bp, synthetic construct
  source 1..23: mol_type = other DNA
tggaccrgcggggaggcacctgg

SEQ ID NO: 3318 - DNA, 23 bp, synthetic construct
  source 1..23: mol_type = other DNA
ctggaacgrcaggctccttgcgg

SEQ ID NO: 3319 - DNA, 23 bp, synthetic construct
  source 1..23: mol_type = other DNA
catccrcgtaggtgtcaaagtgg

SEQ ID NO: 3320 - DNA, 23 bp, synthetic construct
  source 1..23: mol_type = other DNA
tggtrgggcctggtgagttgtgg

SEQ ID NO: 3321 - DNA, 23 bp, synthetic construct
  source 1..23: mol_type = other DNA
ctacgtrtgagtggccggcgggg

SEQ ID NO: 3322 - DNA, 23 bp, synthetic construct
  source 1..23: mol_type = other DNA
cctacgtrtgagtggccggcggg

SEQ ID NO: 3323 - DNA, 23 bp, synthetic construct
  source 1..23: mol_type = other DNA
gcctacgtrtgagtggccggcgg

SEQ ID NO: 3324 - DNA, 23 bp, synthetic construct
  source 1..23: mol_type = other DNA
tgcrgatgatccgcatggaccgg

SEQ ID NO: 3325 - DNA, 23 bp, synthetic construct
  source 1..23: mol_type = other DNA
gattctgcrgatgatccgcatgg

SEQ ID NO: 3326 - DNA, 23 bp, synthetic construct
  source 1..23: mol_type = other DNA
aagaggcrgaacccggcagcagg

SEQ ID NO: 3327 - DNA, 23 bp, synthetic construct
  source 1..23: mol_type = other DNA
tacrcggatgcactctggtgggg

SEQ ID NO: 3328 - DNA, 23 bp, synthetic construct
  source 1..23: mol_type = other DNA
ctacrcggatgcactctggtggg

SEQ ID NO: 3329 - DNA, 23 bp, synthetic construct
  source 1..23: mol_type = other DNA
cctacrcggatgcactctggtgg

SEQ ID NO: 3330 - DNA, 23 bp, synthetic construct
  source 1..23: mol_type = other DNA
acacctacrcggatgcactctgg

SEQ ID NO: 3331 - DNA, 23 bp, synthetic construct
  source 1..23: mol_type = other DNA
ccctgaaggttcaggagyagcac

SEQ ID NO: 3332 - DNA, 23 bp, synthetic construct
  source 1..23: mol_type = other DNA
cctgaaggttcaggagyagcaca

SEQ ID NO: 3333 - DNA, 23 bp, synthetic construct
  source 1..23: mol_type = other DNA
cccctgtgtggatgctgcyccgg

SEQ ID NO: 3334 - DNA, 23 bp, synthetic construct
  source 1..23: mol_type = other DNA
ccctgtgtggatgctgcyccgga

SEQ ID NO: 3335 - DNA, 23 bp, synthetic construct
  source 1..23: mol_type = other DNA
cctgtgtggatgctgcyccggac

SEQ ID NO: 3336 - DNA, 23 bp, synthetic construct
  source 1..23: mol_type = other DNA
ccacctggacatgctgtccygaa

SEQ ID NO: 3337 - DNA, 23 bp, synthetic construct
  source 1..23: mol_type = other DNA
cctggacatgctgtccygaatta

SEQ ID NO: 3338 - DNA, 23 bp, synthetic construct
  source 1..23: mol_type = other DNA
cccaaaacgtgggaaggcygtct

SEQ ID NO: 3339 - DNA, 23 bp, synthetic construct
  source 1..23: mol_type = other DNA
ccaaaacgtgggaaggcygtctg

SEQ ID NO: 3340 - DNA, 23 bp, synthetic construct
  source 1..23: mol_type = other DNA
aggctccrgctttgccctgaagg

SEQ ID NO: 3341 - DNA, 23 bp, synthetic construct
  source 1..23: mol_type = other DNA
ctgrgcagggtcctggctgctgg

SEQ ID NO: 3342 - DNA, 23 bp, synthetic construct
  source 1..23: mol_type = other DNA
cagcrggtcatctacctccaggg

SEQ ID NO: 3343 - DNA, 23 bp, synthetic construct
  source 1..23: mol_type = other DNA
ccagcrggtcatctacctccagg

SEQ ID NO: 3344 - DNA, 23 bp, synthetic construct
  source 1..23: mol_type = other DNA
cctgcrcgcctgggccgtgaagg

SEQ ID NO: 3345 - DNA, 23 bp, synthetic construct
  source 1..23: mol_type = other DNA
gacctgcrgcatccagcacctgg

SEQ ID NO: 3346 - DNA, 23 bp, synthetic construct
  source 1..23: mol_type = other DNA
cccacccttccaacatgygcttc

SEQ ID NO: 3347 - DNA, 23 bp, synthetic construct
  source 1..23: mol_type = other DNA
ccacccttccaacatgygcttca

SEQ ID NO: 3348 - DNA, 23 bp, synthetic construct
  source 1..23: mol_type = other DNA
cctggcagaagaggacyagcagg

SEQ ID NO: 3349 - DNA, 23 bp, synthetic construct
  source 1..23: mol_type = other DNA
gtaccrcgtgctgcagtgccagg

SEQ ID NO: 3350 - DNA, 23 bp, synthetic construct
  source 1..23: mol_type = other DNA
ccccacggactccgagggcyggt

SEQ ID NO: 3351 - DNA, 23 bp, synthetic construct
  source 1..23: mol_type = other DNA
cccacggactccgagggcyggta

SEQ ID NO: 3352 - DNA, 23 bp, synthetic construct
  source 1..23: mol_type = other DNA
ccacggactccgagggcyggtac

SEQ ID NO: 3353 - DNA, 23 bp, synthetic construct
  source 1..23: mol_type = other DNA
cccagacggccttgtctgcyttt

SEQ ID NO: 3354 - DNA, 23 bp, synthetic construct
  source 1..23: mol_type = other DNA
ccagacggccttgtctgcytttc

SEQ ID NO: 3355 - DNA, 23 bp, synthetic construct
  source 1..23: mol_type = other DNA
cctgacccttcttgacctayaga

SEQ ID NO: 3356 - DNA, 23 bp, synthetic construct
  source 1..23: mol_type = other DNA
cccttcttgacctayagaacaac

SEQ ID NO: 3357 - DNA, 23 bp, synthetic construct
  source 1..23: mol_type = other DNA
aaattaaargttgatcttgcagg

SEQ ID NO: 3358 - DNA, 23 bp, synthetic construct
  source 1..23: mol_type = other DNA
agcragcgggctgactccacggg

SEQ ID NO: 3359 - DNA, 23 bp, synthetic construct
  source 1..23: mol_type = other DNA
gagcragcgggctgactccacgg

SEQ ID NO: 3360 - DNA, 23 bp, synthetic construct
  source 1..23: mol_type = other DNA
agatatraatagactcctcaagg

SEQ ID NO: 3361 - DNA, 23 bp, synthetic construct
  source 1..23: mol_type = other DNA
cctgctttctcaatagcaayggg

SEQ ID NO: 3362 - DNA, 23 bp, synthetic construct
  source 1..23: mol_type = other DNA
atcrtgacagcaaaatgacaagg

SEQ ID NO: 3363 - DNA, 23 bp, synthetic construct
  source 1..23: mol_type = other DNA
gcagrgagtgagaaggtaggggg

SEQ ID NO: 3364 - DNA, 23 bp, synthetic construct
  source 1..23: mol_type = other DNA
ggcagrgagtgagaaggtagggg

SEQ ID NO: 3365 - DNA, 23 bp, synthetic construct
  source 1..23: mol_type = other DNA
tggcagrgagtgagaaggtaggg

SEQ ID NO: 3366 - DNA, 23 bp, synthetic construct
  source 1..23: mol_type = other DNA
ctggcagrgagtgagaaggtagg

SEQ ID NO: 3367 - DNA, 23 bp, synthetic construct
  source 1..23: mol_type = other DNA
cccagaaggagacgattgygaag

SEQ ID NO: 3368 - DNA, 23 bp, synthetic construct
  source 1..23: mol_type = other DNA
ccagaaggagacgattgygaagc

SEQ ID NO: 3369 - DNA, 23 bp, synthetic construct
  source 1..23: mol_type = other DNA
cccagtgcgggttgccctgygag

SEQ ID NO: 3370 - DNA, 23 bp, synthetic construct
  source 1..23: mol_type = other DNA
ccagtgcgggttgccctgygagt

SEQ ID NO: 3371 - DNA, 23 bp, synthetic construct
  source 1..23: mol_type = other DNA
cctgggctcgcacttcygacagg

SEQ ID NO: 3372 - DNA, 23 bp, synthetic construct
  source 1..23: mol_type = other DNA
ctcaagcrtaagttcctgtatgg

SEQ ID NO: 3373 - DNA, 23 bp, synthetic construct
  source 1..23: mol_type = other DNA
aatggragtttcccagaaacagg

SEQ ID NO: 3374 - DNA, 23 bp, synthetic construct
  source 1..23: mol_type = other DNA
tgacrctcgggcagacagatggg

SEQ ID NO: 3375 - DNA, 23 bp, synthetic construct
  source 1..23: mol_type = other DNA
atgacrctcgggcagacagatgg

SEQ ID NO: 3376 - DNA, 23 bp, synthetic construct
  source 1..23: mol_type = other DNA
cggcrgagcagtgtgggtgtggg

SEQ ID NO: 3377 - DNA, 23 bp, synthetic construct
  source 1..23: mol_type = other DNA
gcggcrgagcagtgtgggtgtgg

SEQ ID NO: 3378 - DNA, 23 bp, synthetic construct
  source 1..23: mol_type = other DNA
ccttccagaagatgcagagyagg

SEQ ID NO: 3379 - DNA, 23 bp, synthetic construct
  source 1..23: mol_type = other DNA
ccagaagatgcagagyaggtgag

SEQ ID NO: 3380 - DNA, 23 bp, synthetic construct
  source 1..23: mol_type = other DNA
ccttcaaacagaggcttygctgg

SEQ ID NO: 3381 - DNA, 23 bp, synthetic construct
  source 1..23: mol_type = other DNA
ggctrgggtctgctggcgaacgg

SEQ ID NO: 3382 - DNA, 23 bp, synthetic construct
  source 1..23: mol_type = other DNA
ccaaggacctgcagyagctcttc

SEQ ID NO: 3383 - DNA, 23 bp, synthetic construct
  source 1..23: mol_type = other DNA
cccatggagcctcacagygatca

SEQ ID NO: 3384 - DNA, 23 bp, synthetic construct
  source 1..23: mol_type = other DNA
ccatggagcctcacagygatcag

SEQ ID NO: 3385 - DNA, 23 bp, synthetic construct
  source 1..23: mol_type = other DNA
cctacggtgggtcagcttygagc

SEQ ID NO: 3386 - DNA, 23 bp, synthetic construct
  source 1..23: mol_type = other DNA
cccggggtggagagctgtyaaaa

SEQ ID NO: 3387 - DNA, 23 bp, synthetic construct
  source 1..23: mol_type = other DNA
ccggggtggagagctgtyaaaac

SEQ ID NO: 3388 - DNA, 23 bp, synthetic construct
  source 1..23: mol_type = other DNA
ccaaaactcccctccttccyagt

SEQ ID NO: 3389 - DNA, 23 bp, synthetic construct
  source 1..23: mol_type = other DNA
cctgattcaaggcttttayagga

SEQ ID NO: 3390 - DNA, 23 bp, synthetic construct
  source 1..23: mol_type = other DNA
cccatgggctctttayagcagct

SEQ ID NO: 3391 - DNA, 23 bp, synthetic construct
  source 1..23: mol_type = other DNA
ccatgggctctttayagcagctt

SEQ ID NO: 3392 - DNA, 23 bp, synthetic construct
  source 1..23: mol_type = other DNA
ccccacctgctggctyagccctc

SEQ ID NO: 3393 - DNA, 23 bp, synthetic construct
  source 1..23: mol_type = other DNA
cccacctgctggctyagccctct

SEQ ID NO: 3394 - DNA, 23 bp, synthetic construct
  source 1..23: mol_type = other DNA
ccaatctggatgtgygacagctc

SEQ ID NO: 3395 - DNA, 23 bp, synthetic construct
  source 1..23: mol_type = other DNA
ccaggagccaccccctgccyagg

SEQ ID NO: 3396 - DNA, 23 bp, synthetic construct
  source 1..23: mol_type = other DNA
caagrtgcgtgccctggaggagg

SEQ ID NO: 3397 - DNA, 23 bp, synthetic construct
  source 1..23: mol_type = other DNA
ggacaagrtgcgtgccctggagg

SEQ ID NO: 3398 - DNA, 23 bp, synthetic construct
  source 1..23: mol_type = other DNA
agggcraggagtgcaggtgaggg

SEQ ID NO: 3399 - DNA, 23 bp, synthetic construct
  source 1..23: mol_type = other DNA
gagggcraggagtgcaggtgagg

SEQ ID NO: 3400 - DNA, 23 bp, synthetic construct
  source 1..23: mol_type = other DNA
tgccragcagcgtggggagctgg

SEQ ID NO: 3401 - DNA, 23 bp, synthetic construct
  source 1..23: mol_type = other DNA
ccgcctctgccatcacccygtct

SEQ ID NO: 3402 - DNA, 23 bp, synthetic construct
  source 1..23: mol_type = other DNA
cctctgccatcacccygtctgtc

SEQ ID NO: 3403 - DNA, 23 bp, synthetic construct
  source 1..23: mol_type = other DNA
ggagggtraggagtgcaggtggg

SEQ ID NO: 3404 - DNA, 23 bp, synthetic construct
  source 1..23: mol_type = other DNA
tggagggtraggagtgcaggtgg

SEQ ID NO: 3405 - DNA, 23 bp, synthetic construct
  source 1..23: mol_type = other DNA
ggagggcraggagtgcaggtggg

SEQ ID NO: 3406 - DNA, 23 bp, synthetic construct
  source 1..23: mol_type = other DNA
tggagggcraggagtgcaggtgg

SEQ ID NO: 3407 - DNA, 23 bp, synthetic construct
  source 1..23: mol_type = other DNA
cctacctgcactcctygccctcc

SEQ ID NO: 3408 - DNA, 23 bp, synthetic construct
  source 1..23: mol_type = other DNA
atatcragatcgccacctacagg

SEQ ID NO: 3409 - DNA, 23 bp, synthetic construct
  source 1..23: mol_type = other DNA
taagrtgcaggctctagaggagg

SEQ ID NO: 3410 - DNA, 23 bp, synthetic construct
  source 1..23: mol_type = other DNA
ggataagrtgcaggctctagagg

SEQ ID NO: 3411 - DNA, 23 bp, synthetic construct
  source 1..23: mol_type = other DNA
actgratgtggtggagagtaggg

SEQ ID NO: 3412 - DNA, 23 bp, synthetic construct
  source 1..23: mol_type = other DNA
aactgratgtggtggagagtagg

SEQ ID NO: 3413 - DNA, 23 bp, synthetic construct
  source 1..23: mol_type = other DNA
atcaacrggatccctgtggaggg

SEQ ID NO: 3414 - DNA, 23 bp, synthetic construct
  source 1..23: mol_type = other DNA
aatcaacrggatccctgtggagg

SEQ ID NO: 3415 - DNA, 23 bp, synthetic construct
  source 1..23: mol_type = other DNA
cgcrtgcagtggcgccctcaggg

SEQ ID NO: 3416 - DNA, 23 bp, synthetic construct
  source 1..23: mol_type = other DNA
ccgcrtgcagtggcgccctcagg

SEQ ID NO: 3417 - DNA, 23 bp, synthetic construct
  source 1..23: mol_type = other DNA
tcgttgrtggcggaattgtgggg

SEQ ID NO: 3418 - DNA, 23 bp, synthetic construct
  source 1..23: mol_type = other DNA
atcgttgrtggcggaattgtggg

SEQ ID NO: 3419 - DNA, 23 bp, synthetic construct
  source 1..23: mol_type = other DNA
catcgttgrtggcggaattgtgg

SEQ ID NO: 3420 - DNA, 23 bp, synthetic construct
  source 1..23: mol_type = other DNA
acagatrtcagagttcctactgg

SEQ ID NO: 3421 - DNA, 23 bp, synthetic construct
  source 1..23: mol_type = other DNA
aagagrtacagtcgaggcatggg

SEQ ID NO: 3422 - DNA, 23 bp, synthetic construct
  source 1..23: mol_type = other DNA
aaagagrtacagtcgaggcatgg

SEQ ID NO: 3423 - DNA, 23 bp, synthetic construct
  source 1..23: mol_type = other DNA
gcarcctgtcgctgtaatgccgg

SEQ ID NO: 3424 - DNA, 23 bp, synthetic construct
  source 1..23: mol_type = other DNA
tcaratgacctcaagcagtttgg

SEQ ID NO: 3425 - DNA, 23 bp, synthetic construct
  source 1..23: mol_type = other DNA
ccagtattccgttcygaggttgc

SEQ ID NO: 3426 - DNA, 23 bp, synthetic construct
  source 1..23: mol_type = other DNA
ccacctaggagaaaaygaaggca

SEQ ID NO: 3427 - DNA, 23 bp, synthetic construct
  source 1..23: mol_type = other DNA
ccgttcatgtagagygaactaga

SEQ ID NO: 3428 - DNA, 23 bp, synthetic construct
  source 1..23: mol_type = other DNA
ccatagaactgtgaccygagaag

SEQ ID NO: 3429 - DNA, 23 bp, synthetic construct
  source 1..23: mol_type = other DNA
ccaaaggctgtcttyagaaaagc

SEQ ID NO: 3430 - DNA, 23 bp, synthetic construct
  source 1..23: mol_type = other DNA
ccaatctcacaactctcygagat

SEQ ID NO: 3431 - DNA, 23 bp, synthetic construct
  source 1..23: mol_type = other DNA
ccaatcatggagccctcyagttt

SEQ ID NO: 3432 - DNA, 23 bp, synthetic construct
  source 1..23: mol_type = other DNA
ccgtgggcagggctgygatgtga

SEQ ID NO: 3433 - DNA, 23 bp, synthetic construct
  source 1..23: mol_type = other DNA
ccagcgggcacttggcaagytct

SEQ ID NO: 3434 - DNA, 23 bp, synthetic construct
  source 1..23: mol_type = other DNA
gtgrtcagggcctgggctggagg

SEQ ID NO: 3435 - DNA, 23 bp, synthetic construct
  source 1..23: mol_type = other DNA
cctgtgrtcagggcctgggctgg

SEQ ID NO: 3436 - DNA, 23 bp, synthetic construct
  source 1..23: mol_type = other DNA
cctactatgctgtgtccyagctc

SEQ ID NO: 3437 - DNA, 23 bp, synthetic construct
  source 1..23: mol_type = other DNA
ccgccagggtcggcctyagagct

SEQ ID NO: 3438 - DNA, 23 bp, synthetic construct
  source 1..23: mol_type = other DNA
ccaactctgtttcctttyccacc

SEQ ID NO: 3439 - DNA, 23 bp, synthetic construct
  source 1..23: mol_type = other DNA
ccagccctgtgactgcyagtcgg

SEQ ID NO: 3440 - DNA, 23 bp, synthetic construct
  source 1..23: mol_type = other DNA
ggctccrgtaagcaaagcactgg

SEQ ID NO: 3441 - DNA, 23 bp, synthetic construct
  source 1..23: mol_type = other DNA
ccacacccgctccgagyagtgct

SEQ ID NO: 3442 - DNA, 23 bp, synthetic construct
  source 1..23: mol_type = other DNA
cctgttcatgcaaaaaygaaaga

SEQ ID NO: 3443 - DNA, 23 bp, synthetic construct
  source 1..23: mol_type = other DNA
cccacagggtacctgcacayact

SEQ ID NO: 3444 - DNA, 23 bp, synthetic construct
  source 1..23: mol_type = other DNA
ccacagggtacctgcacayactg

SEQ ID NO: 3445 - DNA, 23 bp, synthetic construct
  source 1..23: mol_type = other DNA
ccagcaggaggagtactacygca

SEQ ID NO: 3446 - DNA, 23 bp, synthetic construct
  source 1..23: mol_type = other DNA
tgcratttccccgtggaggctgg

SEQ ID NO: 3447 - DNA, 23 bp, synthetic construct
  source 1..23: mol_type = other DNA
tggctgcratttccccgtggagg

SEQ ID NO: 3448 - DNA, 23 bp, synthetic construct
  source 1..23: mol_type = other DNA
ccaaaagccctgccgggctygag

SEQ ID NO: 3449 - DNA, 23 bp, synthetic construct
  source 1..23: mol_type = other DNA
cccacgttttgccaaattgygca

SEQ ID NO: 3450 - DNA, 23 bp, synthetic construct
  source 1..23: mol_type = other DNA
ccacgttttgccaaattgygcaa

SEQ ID NO: 3451 - DNA, 23 bp, synthetic construct
  source 1..23: mol_type = other DNA
cctgtactcggcagagaycctga

SEQ ID NO: 3452 - DNA, 23 bp, synthetic construct
  source 1..23: mol_type = other DNA
ctgcccgracggcatgctgctgg

SEQ ID NO: 3453 - DNA, 23 bp, synthetic construct
  source 1..23: mol_type = other DNA
gcgaaratggctcggatgagtgg

SEQ ID NO: 3454 - DNA, 23 bp, synthetic construct
  source 1..23: mol_type = other DNA
ggacgrctacagctacccctcgg

SEQ ID NO: 3455 - DNA, 23 bp, synthetic construct
  source 1..23: mol_type = other DNA
gacraattccagtgctctgatgg

SEQ ID NO: 3456 - DNA, 23 bp, synthetic construct
  source 1..23: mol_type = other DNA
gaaaggggrcctgaatggtgtgg

SEQ ID NO: 3457 - DNA, 23 bp, synthetic construct
  source 1..23: mol_type = other DNA
ccccracggcttccagctggtgg

SEQ ID NO: 3458 - DNA, 23 bp, synthetic construct
  source 1..23: mol_type = other DNA
gtgccccracggcttccagctgg

SEQ ID NO: 3459 - DNA, 23 bp, synthetic construct
  source 1..23: mol_type = other DNA
ctgcaagracaaatctgacgagg

SEQ ID NO: 3460 - DNA, 23 bp, synthetic construct
  source 1..23: mol_type = other DNA
cccgactgcgaagatggctygga

SEQ ID NO: 3461 - DNA, 23 bp, synthetic construct
  source 1..23: mol_type = other DNA
ccgactgcgaagatggctyggat

SEQ ID NO: 3462 - DNA, 23 bp, synthetic construct
  source 1..23: mol_type = other DNA
ccactgcctaagtggygagtgca

SEQ ID NO: 3463 - DNA, 23 bp, synthetic construct
  source 1..23: mol_type = other DNA
cccccagctgtgggcctghgaca

SEQ ID NO: 3464 - DNA, 23 bp, synthetic construct
  source 1..23: mol_type = other DNA
ccccagctgtgggcctghgacaa

SEQ ID NO: 3465 - DNA, 23 bp, synthetic construct
  source 1..23: mol_type = other DNA
cccagctgtgggcctghgacaac

SEQ ID NO: 3466 - DNA, 23 bp, synthetic construct
  source 1..23: mol_type = other DNA
ccagctgtgggcctghgacaacg

SEQ ID NO: 3467 - DNA, 23 bp, synthetic construct
  source 1..23: mol_type = other DNA
agagctrggggggcggtggccgg

SEQ ID NO: 3468 - DNA, 23 bp, synthetic construct
  source 1..23: mol_type = other DNA
ggtcarcctgcccaacatgaggg

SEQ ID NO: 3469 - DNA, 23 bp, synthetic construct
  source 1..23: mol_type = other DNA
tggtcarcctgcccaacatgagg

SEQ ID NO: 3470 - DNA, 23 bp, synthetic construct
  source 1..23: mol_type = other DNA
ccatttctggggccgygacagtg

SEQ ID NO: 3471 - DNA, 23 bp, synthetic construct
  source 1..23: mol_type = other DNA
tgccgrctactgccccaccatgg

SEQ ID NO: 3472 - DNA, 23 bp, synthetic construct
  source 1..23: mol_type = other DNA
ccagaaccgccgggycaaggaga

SEQ ID NO: 3473 - DNA, 23 bp, synthetic construct
  source 1..23: mol_type = other DNA
cctgctgccctgacaggygcttc

SEQ ID NO: 3474 - DNA, 23 bp, synthetic construct
  source 1..23: mol_type = other DNA
cctgcraatacaaatatgacggg

SEQ ID NO: 3475 - DNA, 23 bp, synthetic construct
  source 1..23: mol_type = other DNA
acctgcraatacaaatatgacgg

SEQ ID NO: 3476 - DNA, 23 bp, synthetic construct
  source 1..23: mol_type = other DNA
cctgggccgggggaagygggccg

SEQ ID NO: 3477 - DNA, 23 bp, synthetic construct
  source 1..23: mol_type = other DNA
gttggagratattggggtaaagg

SEQ ID NO: 3478 - DNA, 23 bp, synthetic construct
  source 1..23: mol_type = other DNA
cctctcagtatgtttygacgcca

SEQ ID NO: 3479 - DNA, 23 bp, synthetic construct
  source 1..23: mol_type = other DNA
cctggaatgcctacytggctcca

SEQ ID NO: 3480 - DNA, 23 bp, synthetic construct
  source 1..23: mol_type = other DNA
ataacgccrgtgctctgacctgg

SEQ ID NO: 3481 - DNA, 23 bp, synthetic construct
  source 1..23: mol_type = other DNA
ccgcgaaccacatcagcyagtcc

SEQ ID NO: 3482 - DNA, 23 bp, synthetic construct
  source 1..23: mol_type = other DNA
gcgcgrtgagttcgcccaggtgg

SEQ ID NO: 3483 - DNA, 23 bp, synthetic construct
  source 1..23: mol_type = other DNA
aaagcgcgrtgagttcgcccagg

SEQ ID NO: 3484 - DNA, 23 bp, synthetic construct
  source 1..23: mol_type = other DNA
gtcacccrctcctacctcctggg

SEQ ID NO: 3485 - DNA, 23 bp, synthetic construct
  source 1..23: mol_type = other DNA
ggtcacccrctcctacctcctgg

SEQ ID NO: 3486 - DNA, 23 bp, synthetic construct
  source 1..23: mol_type = other DNA
gcgcrtggccgtggaggaggtgg

SEQ ID NO: 3487 - DNA, 23 bp, synthetic construct
  source 1..23: mol_type = other DNA
cgggcgcrtggccgtggaggagg

SEQ ID NO: 3488 - DNA, 23 bp, synthetic construct
  source 1..23: mol_type = other DNA
acgrctctcatcaactccactgg

SEQ ID NO: 3489 - DNA, 23 bp, synthetic construct
  source 1..23: mol_type = other DNA
gtgrgcggacccatctcctctgg

SEQ ID NO: 3490 - DNA, 23 bp, synthetic construct
  source 1..23: mol_type = other DNA
agatggccragatgcgggcaagg

SEQ ID NO: 3491 - DNA, 23 bp, synthetic construct
  source 1..23: mol_type = other DNA
atgagrtaggctcctgctcaggg

SEQ ID NO: 3492 - DNA, 23 bp, synthetic construct
  source 1..23: mol_type = other DNA
aatgagrtaggctcctgctcagg

SEQ ID NO: 3493 - DNA, 23 bp, synthetic construct
  source 1..23: mol_type = other DNA
ggcrggtggatgctgagaacagg

SEQ ID NO: 3494 - DNA, 23 bp, synthetic construct
  source 1..23: mol_type = other DNA
gagrtgggctggggagacgtcgg

SEQ ID NO: 3495 - DNA, 23 bp, synthetic construct
  source 1..23: mol_type = other DNA
gaartaagtaggcctgggcctgg

SEQ ID NO: 3496 - DNA, 23 bp, synthetic construct
  source 1..23: mol_type = other DNA
ctggggaartaagtaggcctggg

SEQ ID NO: 3497 - DNA, 23 bp, synthetic construct
  source 1..23: mol_type = other DNA
acgrtgagtggcagggcgcttgg

SEQ ID NO: 3498 - DNA, 23 bp, synthetic construct
  source 1..23: mol_type = other DNA
cgcctacraggccgagctcgggg

SEQ ID NO: 3499 - DNA, 23 bp, synthetic construct
  source 1..23: mol_type = other DNA
ccgcctacraggccgagctcggg

SEQ ID NO: 3500 - DNA, 23 bp, synthetic construct
  source 1..23: mol_type = other DNA
ctgcvggaacagcctgcgtacgg

SEQ ID NO: 3501 - DNA, 23 bp, synthetic construct
  source 1..23: mol_type = other DNA
ggcragctgcatgatctgcgggg

SEQ ID NO: 3502 - DNA, 23 bp, synthetic construct
  source 1..23: mol_type = other DNA
gggcragctgcatgatctgcggg

SEQ ID NO: 3503 - DNA, 23 bp, synthetic construct
  source 1..23: mol_type = other DNA
agggcragctgcatgatctgcgg

SEQ ID NO: 3504 - DNA, 23 bp, synthetic construct
  source 1..23: mol_type = other DNA
ccgcaagctcttggagggygagg

SEQ ID NO: 3505 - DNA, 23 bp, synthetic construct
  source 1..23: mol_type = other DNA
ccaacccttccaggagctgygtg

SEQ ID NO: 3506 - DNA, 23 bp, synthetic construct
  source 1..23: mol_type = other DNA
cccttccaggagctgygtgagac

SEQ ID NO: 3507 - DNA, 23 bp, synthetic construct
  source 1..23: mol_type = other DNA
ccttccaggagctgygtgagacc

SEQ ID NO: 3508 - DNA, 23 bp, synthetic construct
  source 1..23: mol_type = other DNA
cccactgcagcagctygggggac

SEQ ID NO: 3509 - DNA, 23 bp, synthetic construct
  source 1..23: mol_type = other DNA
ccactgcagcagctygggggacc

SEQ ID NO: 3510 - DNA, 23 bp, synthetic construct
  source 1..23: mol_type = other DNA
ccctgaaggctgggyaggtggtg

SEQ ID NO: 3511 - DNA, 23 bp, synthetic construct
  source 1..23: mol_type = other DNA
ccctacctcgcagcgcagcygtg

SEQ ID NO: 3512 - DNA, 23 bp, synthetic construct
  source 1..23: mol_type = other DNA
cctacctcgcagcgcagcygtgg

SEQ ID NO: 3513 - DNA, 23 bp, synthetic construct
  source 1..23: mol_type = other DNA
cctcgcagcgcagcygtggccgt

SEQ ID NO: 3514 - DNA, 23 bp, synthetic construct
  source 1..23: mol_type = other DNA
cccttgctgacttacyggttccc

SEQ ID NO: 3515 - DNA, 23 bp, synthetic construct
  source 1..23: mol_type = other DNA
ccttgctgacttacyggttccca

SEQ ID NO: 3516 - DNA, 23 bp, synthetic construct
  source 1..23: mol_type = other DNA
ccaaggaggcgaagcttygagac

SEQ ID NO: 3517 - DNA, 23 bp, synthetic construct
  source 1..23: mol_type = other DNA
ccggctggcggatgcgctgyagg

SEQ ID NO: 3518 - DNA, 23 bp, synthetic construct
  source 1..23: mol_type = other DNA
ccgtcccagcggcgcgccayccg

SEQ ID NO: 3519 - DNA, 23 bp, synthetic construct
  source 1..23: mol_type = other DNA
cccagcggcgcgccayccgcagc

SEQ ID NO: 3520 - DNA, 23 bp, synthetic construct
  source 1..23: mol_type = other DNA
ccagcggcgcgccayccgcagcg

SEQ ID NO: 3521 - DNA, 23 bp, synthetic construct
  source 1..23: mol_type = other DNA
ccatggagaccccgtccyagcgg

SEQ ID NO: 3522 - DNA, 23 bp, synthetic construct
  source 1..23: mol_type = other DNA
cccgcggaggcccaagygacccc

SEQ ID NO: 3523 - DNA, 23 bp, synthetic construct
  source 1..23: mol_type = other DNA
ccgcggaggcccaagygaccccg

SEQ ID NO: 3524 - DNA, 23 bp, synthetic construct
  source 1..23: mol_type = other DNA
cctcaccacgcagcagygaagag

SEQ ID NO: 3525 - DNA, 23 bp, synthetic construct
  source 1..23: mol_type = other DNA
cctctctctgagccaggtcygag

SEQ ID NO: 3526 - DNA, 23 bp, synthetic construct
  source 1..23: mol_type = other DNA
atcrctccccagtgtccccgagg

SEQ ID NO: 3527 - DNA, 23 bp, synthetic construct
  source 1..23: mol_type = other DNA
ccgttttagataaaygaagccga

SEQ ID NO: 3528 - DNA, 23 bp, synthetic construct
  source 1..23: mol_type = other DNA
gagttrggtgccaaaacttgtgg

SEQ ID NO: 3529 - DNA, 23 bp, synthetic construct
  source 1..23: mol_type = other DNA
ttgraatccagaaaccagttggg

SEQ ID NO: 3530 - DNA, 23 bp, synthetic construct
  source 1..23: mol_type = other DNA
attgraatccagaaaccagttgg

SEQ ID NO: 3531 - DNA, 23 bp, synthetic construct
  source 1..23: mol_type = other DNA
ccaaactggtgggayaggatgtg

SEQ ID NO: 3532 - DNA, 23 bp, synthetic construct
  source 1..23: mol_type = other DNA
caaatrtaaggccaaaaatctgg

SEQ ID NO: 3533 - DNA, 23 bp, synthetic construct
  source 1..23: mol_type = other DNA
ccaccatggccaacaagygatca

SEQ ID NO: 3534 - DNA, 23 bp, synthetic construct
  source 1..23: mol_type = other DNA
ccatggccaacaagygatcattc

SEQ ID NO: 3535 - DNA, 23 bp, synthetic construct
  source 1..23: mol_type = other DNA
ccagtacaatcgtgaagcaytaa

SEQ ID NO: 3536 - DNA, 23 bp, synthetic construct
  source 1..23: mol_type = other DNA
ccagaagtgtgaaagcygacctg

SEQ ID NO: 3537 - DNA, 23 bp, synthetic construct
  source 1..23: mol_type = other DNA
ggaccractcaggcacctcgagg

SEQ ID NO: 3538 - DNA, 23 bp, synthetic construct
  source 1..23: mol_type = other DNA
gaagctrcattgctgagcattgg

SEQ ID NO: 3539 - DNA, 23 bp, synthetic construct
  source 1..23: mol_type = other DNA
ccagtacccttgtcagcayggtg

SEQ ID NO: 3540 - DNA, 23 bp, synthetic construct
  source 1..23: mol_type = other DNA
cgagcrggtgcacaaggtcaagg

SEQ ID NO: 3541 - DNA, 23 bp, synthetic construct
  source 1..23: mol_type = other DNA
cttcrccctgacgctctccgggg

SEQ ID NO: 3542 - DNA, 23 bp, synthetic construct
  source 1..23: mol_type = other DNA
ccttcrccctgacgctctccggg

SEQ ID NO: 3543 - DNA, 23 bp, synthetic construct
  source 1..23: mol_type = other DNA
cccttcrccctgacgctctccgg

SEQ ID NO: 3544 - DNA, 23 bp, synthetic construct
  source 1..23: mol_type = other DNA
ccgcacatttttgggttcaygct

SEQ ID NO: 3545 - DNA, 23 bp, synthetic construct
  source 1..23: mol_type = other DNA
ccatcgactacgaccygctagag

SEQ ID NO: 3546 - DNA, 23 bp, synthetic construct
  source 1..23: mol_type = other DNA
ccccttcgccctgaygctctccg

SEQ ID NO: 3547 - DNA, 23 bp, synthetic construct
  source 1..23: mol_type = other DNA
ccgcatcgaggtgacgygcctca

SEQ ID NO: 3548 - DNA, 23 bp, synthetic construct
  source 1..23: mol_type = other DNA
cccgttcggtctgacgyagtaca

SEQ ID NO: 3549 - DNA, 23 bp, synthetic construct
  source 1..23: mol_type = other DNA
ccgttcggtctgacgyagtacag

SEQ ID NO: 3550 - DNA, 23 bp, synthetic construct
  source 1..23: mol_type = other DNA
attgagcragcagctctggatgg

SEQ ID NO: 3551 - DNA, 23 bp, synthetic construct
  source 1..23: mol_type = other DNA
tgcragtacttgagccacatggg

SEQ ID NO: 3552 - DNA, 23 bp, synthetic construct
  source 1..23: mol_type = other DNA
ctgcragtacttgagccacatgg

SEQ ID NO: 3553 - DNA, 23 bp, synthetic construct
  source 1..23: mol_type = other DNA
gctrcacccagggcgctagctgg

SEQ ID NO: 3554 - DNA, 23 bp, synthetic construct
  source 1..23: mol_type = other DNA
agatrtgaatgagtgcatggggg

SEQ ID NO: 3555 - DNA, 23 bp, synthetic construct
  source 1..23: mol_type = other DNA
cagatrtgaatgagtgcatgggg

SEQ ID NO: 3556 - DNA, 23 bp, synthetic construct
  source 1..23: mol_type = other DNA
gcagatrtgaatgagtgcatggg

SEQ ID NO: 3557 - DNA, 23 bp, synthetic construct
  source 1..23: mol_type = other DNA
tgcagatrtgaatgagtgcatgg

SEQ ID NO: 3558 - DNA, 23 bp, synthetic construct
  source 1..23: mol_type = other DNA
ccgtcccgcgcgcagyagtcgcg

SEQ ID NO: 3559 - DNA, 23 bp, synthetic construct
  source 1..23: mol_type = other DNA
cccagcagcacccaggcctygag

SEQ ID NO: 3560 - DNA, 23 bp, synthetic construct
  source 1..23: mol_type = other DNA
ccagcagcacccaggcctygagg

SEQ ID NO: 3561 - DNA, 23 bp, synthetic construct
  source 1..23: mol_type = other DNA
cctgggccaggagccacccygag

SEQ ID NO: 3562 - DNA, 23 bp, synthetic construct
  source 1..23: mol_type = other DNA
aatratgccagagcattagaagg

SEQ ID NO: 3563 - DNA, 23 bp, synthetic construct
  source 1..23: mol_type = other DNA
cctcacttcaaagtataygactt

SEQ ID NO: 3564 - DNA, 23 bp, synthetic construct
  source 1..23: mol_type = other DNA
cgcrgagccgctggcttcgcagg

SEQ ID NO: 3565 - DNA, 23 bp, synthetic construct
  source 1..23: mol_type = other DNA
ccccccgttaccaccactyggcc

SEQ ID NO: 3566 - DNA, 23 bp, synthetic construct
  source 1..23: mol_type = other DNA
cccccgttaccaccactyggccg

SEQ ID NO: 3567 - DNA, 23 bp, synthetic construct
  source 1..23: mol_type = other DNA
ccccgttaccaccactyggccgt

SEQ ID NO: 3568 - DNA, 23 bp, synthetic construct
  source 1..23: mol_type = other DNA
cccgttaccaccactyggccgtc

SEQ ID NO: 3569 - DNA, 23 bp, synthetic construct
  source 1..23: mol_type = other DNA
ccgttaccaccactyggccgtcg

SEQ ID NO: 3570 - DNA, 23 bp, synthetic construct
  source 1..23: mol_type = other DNA
cctgcagccagccggctyggtgt

SEQ ID NO: 3571 - DNA, 23 bp, synthetic construct
  source 1..23: mol_type = other DNA
ccgtgccctcgtcgyccagcttc

SEQ ID NO: 3572 - DNA, 23 bp, synthetic construct
  source 1..23: mol_type = other DNA
ccgtgccctcgtcgcycagcttc

SEQ ID NO: 3573 - DNA, 23 bp, synthetic construct
  source 1..23: mol_type = other DNA
ccaagccaaggtgcctgtcyagc

SEQ ID NO: 3574 - DNA, 23 bp, synthetic construct
  source 1..23: mol_type = other DNA
ccaaggtgcctgtcyagcgctcg

SEQ ID NO: 3575 - DNA, 23 bp, synthetic construct
  source 1..23: mol_type = other DNA
cctggcaaactcctggygatact

SEQ ID NO: 3576 - DNA, 23 bp, synthetic construct
  source 1..23: mol_type = other DNA
ccttccaccagtaagyagatagt

SEQ ID NO: 3577 - DNA, 23 bp, synthetic construct
  source 1..23: mol_type = other DNA
cctgtttgagagcacgatcygca

SEQ ID NO: 3578 - DNA, 23 bp, synthetic construct
  source 1..23: mol_type = other DNA
tgggrtgagtggcacaggctggg

SEQ ID NO: 3579 - DNA, 23 bp, synthetic construct
  source 1..23: mol_type = other DNA
gtgggrtgagtggcacaggctgg

SEQ ID NO: 3580 - DNA, 23 bp, synthetic construct
  source 1..23: mol_type = other DNA
tccagrtacaacgccagtatagg

SEQ ID NO: 3581 - DNA, 23 bp, synthetic construct
  source 1..23: mol_type = other DNA
cctgctgcctgttcgcyagacct

SEQ ID NO: 3582 - DNA, 23 bp, synthetic construct
  source 1..23: mol_type = other DNA
tggcragatcagtatctgcatgg

SEQ ID NO: 3583 - DNA, 23 bp, synthetic construct
  source 1..23: mol_type = other DNA
cctgagcaaggtgacctycaagt

SEQ ID NO: 3584 - DNA, 23 bp, synthetic construct
  source 1..23: mol_type = other DNA
ccctgctgacatctggygcttct

SEQ ID NO: 3585 - DNA, 23 bp, synthetic construct
  source 1..23: mol_type = other DNA
cctgctgacatctggygcttcta

SEQ ID NO: 3586 - DNA, 23 bp, synthetic construct
  source 1..23: mol_type = other DNA
ccgcaccacggaggccyggcacc

SEQ ID NO: 3587 - DNA, 23 bp, synthetic construct
  source 1..23: mol_type = other DNA
cctgaggccaaggtcaccyagca

SEQ ID NO: 3588 - DNA, 23 bp, synthetic construct
  source 1..23: mol_type = other DNA
ccacatcattcggaaagcygaca

SEQ ID NO: 3589 - DNA, 23 bp, synthetic construct
  source 1..23: mol_type = other DNA
cactggccrtaagattattgtgg

SEQ ID NO: 3590 - DNA, 23 bp, synthetic construct
  source 1..23: mol_type = other DNA
cctggccrcgcccgcggtgcagg

SEQ ID NO: 3591 - DNA, 23 bp, synthetic construct
  source 1..23: mol_type = other DNA
aagrtgagcacccgagctcgtgg

SEQ ID NO: 3592 - DNA, 23 bp, synthetic construct
  source 1..23: mol_type = other DNA
atgrcaccaagggagaaaagggg

SEQ ID NO: 3593 - DNA, 23 bp, synthetic construct
  source 1..23: mol_type = other DNA
gatgrcaccaagggagaaaaggg

SEQ ID NO: 3594 - DNA, 23 bp, synthetic construct
  source 1..23: mol_type = other DNA
tgatgrcaccaagggagaaaagg

SEQ ID NO: 3595 - DNA, 23 bp, synthetic construct
  source 1..23: mol_type = other DNA
cccaggcaaagatgggygtgatg

SEQ ID NO: 3596 - DNA, 23 bp, synthetic construct
  source 1..23: mol_type = other DNA
ccaggcaaagatgggygtgatgg

SEQ ID NO: 3597 - DNA, 23 bp, synthetic construct
  source 1..23: mol_type = other DNA
cctgagrtgtttgtgactctggg

SEQ ID NO: 3598 - DNA, 23 bp, synthetic construct
  source 1..23: mol_type = other DNA
tcctgagrtgtttgtgactctgg

SEQ ID NO: 3599 - DNA, 23 bp, synthetic construct
  source 1..23: mol_type = other DNA
tggrcagcttgcacggtttcagg

SEQ ID NO: 3600 - DNA, 23 bp, synthetic construct
  source 1..23: mol_type = other DNA
ccacatgttcctgatggycaggc

SEQ ID NO: 3601 - DNA, 23 bp, synthetic construct
  source 1..23: mol_type = other DNA
ccttggtaatgtttcttyctgtt

SEQ ID NO: 3602 - DNA, 23 bp, synthetic construct
  source 1..23: mol_type = other DNA
tacrtattcagcccgggctgtgg

SEQ ID NO: 3603 - DNA, 23 bp, synthetic construct
  source 1..23: mol_type = other DNA
taaggagrtaggtctggcagtgg

SEQ ID NO: 3604 - DNA, 23 bp, synthetic construct
  source 1..23: mol_type = other DNA
cctaatgattttgacttcayggt

SEQ ID NO: 3605 - DNA, 23 bp, synthetic construct
  source 1..23: mol_type = other DNA
cccctcccggcgagagyagaaac

SEQ ID NO: 3606 - DNA, 23 bp, synthetic construct
  source 1..23: mol_type = other DNA
ccctcccggcgagagyagaaacc

SEQ ID NO: 3607 - DNA, 23 bp, synthetic construct
  source 1..23: mol_type = other DNA
cctcccggcgagagyagaaacca

SEQ ID NO: 3608 - DNA, 23 bp, synthetic construct
  source 1..23: mol_type = other DNA
ccacgtcagagggtgtgyaggtg

SEQ ID NO: 3609 - DNA, 23 bp, synthetic construct
  source 1..23: mol_type = other DNA
ccaccacatccaccyaggtcatg

SEQ ID NO: 3610 - DNA, 23 bp, synthetic construct
  source 1..23: mol_type = other DNA
ccagcccccctgagcccyaggac

SEQ ID NO: 3611 - DNA, 23 bp, synthetic construct
  source 1..23: mol_type = other DNA
catgrgatgaaccggtccgatgg

SEQ ID NO: 3612 - DNA, 23 bp, synthetic construct
  source 1..23: mol_type = other DNA
cccccaggaccccctggcgyccc

SEQ ID NO: 3613 - DNA, 23 bp, synthetic construct
  source 1..23: mol_type = other DNA
ccccaggaccccctggcgycccc

SEQ ID NO: 3614 - DNA, 23 bp, synthetic construct
  source 1..23: mol_type = other DNA
cccaggaccccctggcgycccca

SEQ ID NO: 3615 - DNA, 23 bp, synthetic construct
  source 1..23: mol_type = other DNA
ccaggaccccctggcgyccccaa

SEQ ID NO: 3616 - DNA, 23 bp, synthetic construct
  source 1..23: mol_type = other DNA
tggargtgagagagcatgcgtgg

SEQ ID NO: 3617 - DNA, 23 bp, synthetic construct
  source 1..23: mol_type = other DNA
ccgtaaaccagatctcygagttc

SEQ ID NO: 3618 - DNA, 23 bp, synthetic construct
  source 1..23: mol_type = other DNA
cctggtgtaacacatygacctcc

SEQ ID NO: 3619 - DNA, 23 bp, synthetic construct
  source 1..23: mol_type = other DNA
ccgccrttactgggaggtggagg

SEQ ID NO: 3620 - DNA, 23 bp, synthetic construct
  source 1..23: mol_type = other DNA
tggccgccrttactgggaggtgg

SEQ ID NO: 3621 - DNA, 23 bp, synthetic construct
  source 1..23: mol_type = other DNA
gatraaggaaaatgagtaccagg

SEQ ID NO: 3622 - DNA, 23 bp, synthetic construct
  source 1..23: mol_type = other DNA
cctggagcagcaagagyatttct

SEQ ID NO: 3623 - DNA, 23 bp, synthetic construct
  source 1..23: mol_type = other DNA
ctgrcacggcaagggcaacgagg

SEQ ID NO: 3624 - DNA, 23 bp, synthetic construct
  source 1..23: mol_type = other DNA
ctacvacggcatctgcaaatggg

SEQ ID NO: 3625 - DNA, 23 bp, synthetic construct
  source 1..23: mol_type = other DNA
tctacvacggcatctgcaaatgg

SEQ ID NO: 3626 - DNA, 23 bp, synthetic construct
  source 1..23: mol_type = other DNA
gtccarggcacccagagccaagg

SEQ ID NO: 3627 - DNA, 23 bp, synthetic construct
  source 1..23: mol_type = other DNA
ggcatctrcaaatgggaggaggg

SEQ ID NO: 3628 - DNA, 23 bp, synthetic construct
  source 1..23: mol_type = other DNA
cggcatctrcaaatgggaggagg

SEQ ID NO: 3629 - DNA, 23 bp, synthetic construct
  source 1..23: mol_type = other DNA
aagrtgggggcatctaaggaggg

SEQ ID NO: 3630 - DNA, 23 bp, synthetic construct
  source 1..23: mol_type = other DNA
caagrtgggggcatctaaggagg

SEQ ID NO: 3631 - DNA, 23 bp, synthetic construct
  source 1..23: mol_type = other DNA
ccacaagrtgggggcatctaagg

SEQ ID NO: 3632 - DNA, 23 bp, synthetic construct
  source 1..23: mol_type = other DNA
tgctgccdagctgggccgagagg

SEQ ID NO: 3633 - DNA, 23 bp, synthetic construct
  source 1..23: mol_type = other DNA
cccagaagacgctgttccygctg

SEQ ID NO: 3634 - DNA, 23 bp, synthetic construct
  source 1..23: mol_type = other DNA
ccagaagacgctgttccygctgc

SEQ ID NO: 3635 - DNA, 23 bp, synthetic construct
  source 1..23: mol_type = other DNA
ccggtgtggctgagygggtattg

SEQ ID NO: 3636 - DNA, 23 bp, synthetic construct
  source 1..23: mol_type = other DNA
ccagtgctcactttcyagagtga

SEQ ID NO: 3637 - DNA, 23 bp, synthetic construct
  source 1..23: mol_type = other DNA
cctgtccctctatcctygagaag

SEQ ID NO: 3638 - DNA, 23 bp, synthetic construct
  source 1..23: mol_type = other DNA
ccacctttcttgtgyagtcccta

SEQ ID NO: 3639 - DNA, 23 bp, synthetic construct
  source 1..23: mol_type = other DNA
ccacccaaatgtcattygacttc

SEQ ID NO: 3640 - DNA, 23 bp, synthetic construct
  source 1..23: mol_type = other DNA
ccaattgtggtctacttatyaag

SEQ ID NO: 3641 - DNA, 23 bp, synthetic construct
  source 1..23: mol_type = other DNA
ccgtcgctccaattacttcygac

SEQ ID NO: 3642 - DNA, 23 bp, synthetic construct
  source 1..23: mol_type = other DNA
ggctcrgaggcacatgaaagtgg

SEQ ID NO: 3643 - DNA, 23 bp, synthetic construct
  source 1..23: mol_type = other DNA
ggagcrttgtaccagcttcctgg

SEQ ID NO: 3644 - DNA, 23 bp, synthetic construct
  source 1..23: mol_type = other DNA
ctgcaccrccacatagaggaagg

SEQ ID NO: 3645 - DNA, 23 bp, synthetic construct
  source 1..23: mol_type = other DNA
ccctggtattgatgtcaycacag

SEQ ID NO: 3646 - DNA, 23 bp, synthetic construct
  source 1..23: mol_type = other DNA
cctggtattgatgtcaycacaga

SEQ ID NO: 3647 - DNA, 23 bp, synthetic construct
  source 1..23: mol_type = other DNA
ccaagtttgagcagcacayggtc

SEQ ID NO: 3648 - DNA, 23 bp, synthetic construct
  source 1..23: mol_type = other DNA
cctggtgcctctacacccyggtg

SEQ ID NO: 3649 - DNA, 23 bp, synthetic construct
  source 1..23: mol_type = other DNA
cctgaatgtgatgttctctycct

SEQ ID NO: 3650 - DNA, 23 bp, synthetic construct
  source 1..23: mol_type = other DNA
gtgraaacagcggatgattctgg

SEQ ID NO: 3651 - DNA, 23 bp, synthetic construct
  source 1..23: mol_type = other DNA
ccgagggacccggtggcctygtc

SEQ ID NO: 3652 - DNA, 23 bp, synthetic construct
  source 1..23: mol_type = other DNA
tgacacatrattctgtatggagg

SEQ ID NO: 3653 - DNA, 23 bp, synthetic construct
  source 1..23: mol_type = other DNA
ccagtgcatcccctyggcaattg

SEQ ID NO: 3654 - DNA, 23 bp, synthetic construct
  source 1..23: mol_type = other DNA
cctctggatatctgtyattcagc

SEQ ID NO: 3655 - DNA, 23 bp, synthetic construct
  source 1..23: mol_type = other DNA
agtggctrgacagaggaagatgg

SEQ ID NO: 3656 - DNA, 23 bp, synthetic construct
  source 1..23: mol_type = other DNA
gcargtacagtccaaaatctggg

SEQ ID NO: 3657 - DNA, 23 bp, synthetic construct
  source 1..23: mol_type = other DNA
ggcargtacagtccaaaatctgg

SEQ ID NO: 3658 - DNA, 23 bp, synthetic construct
  source 1..23: mol_type = other DNA
ccatgtgctggcaatyaagggac

SEQ ID NO: 3659 - DNA, 23 bp, synthetic construct
  source 1..23: mol_type = other DNA
ccatagaaacagtgtatgyagcc

SEQ ID NO: 3660 - DNA, 23 bp, synthetic construct
  source 1..23: mol_type = other DNA
cctcagtgggccttggcayagca

SEQ ID NO: 3661 - DNA, 23 bp, synthetic construct
  source 1..23: mol_type = other DNA
ccccctttggagggactgcytat

SEQ ID NO: 3662 - DNA, 23 bp, synthetic construct
  source 1..23: mol_type = other DNA
cccctttggagggactgcytatc

SEQ ID NO: 3663 - DNA, 23 bp, synthetic construct
  source 1..23: mol_type = other DNA
ccctttggagggactgcytatct

SEQ ID NO: 3664 - DNA, 23 bp, synthetic construct
  source 1..23: mol_type = other DNA
cctttggagggactgcytatctt

SEQ ID NO: 3665 - DNA, 23 bp, synthetic construct
  source 1..23: mol_type = other DNA
ccagtttagatgcaaaatycaca

SEQ ID NO: 3666 - DNA, 23 bp, synthetic construct
  source 1..23: mol_type = other DNA
cccctgtccagtcagcccyaggc

SEQ ID NO: 3667 - DNA, 23 bp, synthetic construct
  source 1..23: mol_type = other DNA
ccctgtccagtcagcccyaggcc

SEQ ID NO: 3668 - DNA, 23 bp, synthetic construct
  source 1..23: mol_type = other DNA
cctgtccagtcagcccyaggcca

SEQ ID NO: 3669 - DNA, 23 bp, synthetic construct
  source 1..23: mol_type = other DNA
cctatcttcattcttygactagc

SEQ ID NO: 3670 - DNA, 23 bp, synthetic construct
  source 1..23: mol_type = other DNA
cctggagcgggtgcagyagcaca

SEQ ID NO: 3671 - DNA, 23 bp, synthetic construct
  source 1..23: mol_type = other DNA
ccgaaggaaagaagaggaayggc

SEQ ID NO: 3672 - DNA, 23 bp, synthetic construct
  source 1..23: mol_type = other DNA
ctcttrattcccctccttcatgg

SEQ ID NO: 3673 - DNA, 23 bp, synthetic construct
  source 1..23: mol_type = other DNA
ccgtctctcggcccggyggcaca

SEQ ID NO: 3674 - DNA, 23 bp, synthetic construct
  source 1..23: mol_type = other DNA
catgrgggaaccaggtgagaggg

SEQ ID NO: 3675 - DNA, 23 bp, synthetic construct
  source 1..23: mol_type = other DNA
ccatgrgggaaccaggtgagagg

SEQ ID NO: 3676 - DNA, 23 bp, synthetic construct
  source 1..23: mol_type = other DNA
ctgrcgtgattggacttaccggg

SEQ ID NO: 3677 - DNA, 23 bp, synthetic construct
  source 1..23: mol_type = other DNA
actgrcgtgattggacttaccgg

SEQ ID NO: 3678 - DNA, 23 bp, synthetic construct
  source 1..23: mol_type = other DNA
cacragtttggccacgccatggg

SEQ ID NO: 3679 - DNA, 23 bp, synthetic construct
  source 1..23: mol_type = other DNA
ccacragtttggccacgccatgg

SEQ ID NO: 3680 - DNA, 23 bp, synthetic construct
  source 1..23: mol_type = other DNA
gcctgcraatcacagctgatggg

SEQ ID NO: 3681 - DNA, 23 bp, synthetic construct
  source 1..23: mol_type = other DNA
cgcctgcraatcacagctgatgg

SEQ ID NO: 3682 - DNA, 23 bp, synthetic construct
  source 1..23: mol_type = other DNA
ccggcagcacagctacctgygga

SEQ ID NO: 3683 - DNA, 23 bp, synthetic construct
  source 1..23: mol_type = other DNA
ccagctcatccagggagggyggc

SEQ ID NO: 3684 - DNA, 23 bp, synthetic construct
  source 1..23: mol_type = other DNA
aagcrgatctcccagcaaggtgg

SEQ ID NO: 3685 - DNA, 23 bp, synthetic construct
  source 1..23: mol_type = other DNA
gtgaagcrgatctcccagcaagg

SEQ ID NO: 3686 - DNA, 23 bp, synthetic construct
  source 1..23: mol_type = other DNA
cctcttcaaagtgctctyagttg

SEQ ID NO: 3687 - DNA, 23 bp, synthetic construct
  source 1..23: mol_type = other DNA
cctactggctgcagctgygcagc

SEQ ID NO: 3688 - DNA, 23 bp, synthetic construct
  source 1..23: mol_type = other DNA
ccgcaaccagatcaacgygctca

SEQ ID NO: 3689 - DNA, 23 bp, synthetic construct
  source 1..23: mol_type = other DNA
gagaggccrgactctgaccatgg

SEQ ID NO: 3690 - DNA, 23 bp, synthetic construct
  source 1..23: mol_type = other DNA
caactrggccaaactacagcggg

SEQ ID NO: 3691 - DNA, 23 bp, synthetic construct
  source 1..23: mol_type = other DNA
acaactrggccaaactacagcgg

SEQ ID NO: 3692 - DNA, 23 bp, synthetic construct
  source 1..23: mol_type = other DNA
gctrgtacaaggttttggatcgg

SEQ ID NO: 3693 - DNA, 23 bp, synthetic construct
  source 1..23: mol_type = other DNA
aggaggctrgtacaaggttttgg

SEQ ID NO: 3694 - DNA, 23 bp, synthetic construct
  source 1..23: mol_type = other DNA
ccctaggggggctttgcccygtg

SEQ ID NO: 3695 - DNA, 23 bp, synthetic construct
  source 1..23: mol_type = other DNA
cctaggggggctttgcccygtgt

SEQ ID NO: 3696 - DNA, 23 bp, synthetic construct
  source 1..23: mol_type = other DNA
catagtgrgcaagacctctcagg

SEQ ID NO: 3697 - DNA, 23 bp, synthetic construct
  source 1..23: mol_type = other DNA
ggtagrggaccctcgctggaagg

SEQ ID NO: 3698 - DNA, 23 bp, synthetic construct
  source 1..23: mol_type = other DNA
ccatggtgctgtgggctyccggg

SEQ ID NO: 3699 - DNA, 23 bp, synthetic construct
  source 1..23: mol_type = other DNA
ccaacaaaggaagaggcygagga

SEQ ID NO: 3700 - DNA, 23 bp, synthetic construct
  source 1..23: mol_type = other DNA
gtgrattaagcagcctctcatgg

SEQ ID NO: 3701 - DNA, 23 bp, synthetic construct
  source 1..23: mol_type = other DNA
cgacatgrcggtgcagccgaagg

SEQ ID NO: 3702 - DNA, 23 bp, synthetic construct
  source 1..23: mol_type = other DNA
acaggttrgagttgggtatgtgg

SEQ ID NO: 3703 - DNA, 23 bp, synthetic construct
  source 1..23: mol_type = other DNA
ccttaactatgctttatyaggtg

SEQ ID NO: 3704 - DNA, 23 bp, synthetic construct
  source 1..23: mol_type = other DNA
ccattttggagaaaggayaagga

SEQ ID NO: 3705 - DNA, 23 bp, synthetic construct
  source 1..23: mol_type = other DNA
ccgacttgccaagaagtttyaaa

SEQ ID NO: 3706 - DNA, 23 bp, synthetic construct
  source 1..23: mol_type = other DNA
ccacaaaagacatttatyaggac

SEQ ID NO: 3707 - DNA, 23 bp, synthetic construct
  source 1..23: mol_type = other DNA
ccgggaggtgttcaagaccyagg

SEQ ID NO: 3708 - DNA, 23 bp, synthetic construct
  source 1..23: mol_type = other DNA
ccgcagttgatggcyagagacag

SEQ ID NO: 3709 - DNA, 23 bp, synthetic construct
  source 1..23: mol_type = other DNA
cctgttccatatgtacgacyagc

SEQ ID NO: 3710 - DNA, 23 bp, synthetic construct
  source 1..23: mol_type = other DNA
ccctgtcaaagttgctygaaagc

SEQ ID NO: 3711 - DNA, 23 bp, synthetic construct
  source 1..23: mol_type = other DNA
cctgtcaaagttgctygaaagcg

SEQ ID NO: 3712 - DNA, 23 bp, synthetic construct
  source 1..23: mol_type = other DNA
ccaagaagggctgtaaaygatac

SEQ ID NO: 3713 - DNA, 23 bp, synthetic construct
  source 1..23: mol_type = other DNA
ccagaaatgatggaggcaygatg

SEQ ID NO: 3714 - DNA, 23 bp, synthetic construct
  source 1..23: mol_type = other DNA
cccaccctggagcctycgtagac

SEQ ID NO: 3715 - DNA, 23 bp, synthetic construct
  source 1..23: mol_type = other DNA
ccaccctggagcctycgtagacc

SEQ ID NO: 3716 - DNA, 23 bp, synthetic construct
  source 1..23: mol_type = other DNA
tttgtarccacaggcttccacgg

SEQ ID NO: 3717 - DNA, 23 bp, synthetic construct
  source 1..23: mol_type = other DNA
tccaaaaargccttcgatacggg

SEQ ID NO: 3718 - DNA, 23 bp, synthetic construct
  source 1..23: mol_type = other DNA
atccrctaccttcacgccaatgg

SEQ ID NO: 3719 - DNA, 23 bp, synthetic construct
  source 1..23: mol_type = other DNA
atctccrcatgatgaaacttcgg

SEQ ID NO: 3720 - DNA, 23 bp, synthetic construct
  source 1..23: mol_type = other DNA
cttaccraacgaaaaattctagg

SEQ ID NO: 3721 - DNA, 23 bp, synthetic construct
  source 1..23: mol_type = other DNA
aaccrgctttttgcccaaatggg

SEQ ID NO: 3722 - DNA, 23 bp, synthetic construct
  source 1..23: mol_type = other DNA
taaccrgctttttgcccaaatgg

SEQ ID NO: 3723 - DNA, 23 bp, synthetic construct
  source 1..23: mol_type = other DNA
taarcccttactagaccaatggg

SEQ ID NO: 3724 - DNA, 23 bp, synthetic construct
  source 1..23: mol_type = other DNA
ctaarcccttactagaccaatgg

SEQ ID NO: 3725 - DNA, 23 bp, synthetic construct
  source 1..23: mol_type = other DNA
tacactraaaatgtttagacggg

SEQ ID NO: 3726 - DNA, 23 bp, synthetic construct
  source 1..23: mol_type = other DNA
atacactraaaatgtttagacgg

SEQ ID NO: 3727 - DNA, 23 bp, synthetic construct
  source 1..23: mol_type = other DNA
agctaarcaccctaatcaactgg

SEQ ID NO: 3728 - DNA, 23 bp, synthetic construct
  source 1..23: mol_type = other DNA
ccagcaaggactgaaytgttaac

SEQ ID NO: 3729 - DNA, 23 bp, synthetic construct
  source 1..23: mol_type = other DNA
tcacttgrggcatcttccctggg

SEQ ID NO: 3730 - DNA, 23 bp, synthetic construct
  source 1..23: mol_type = other DNA
gtcacttgrggcatcttccctgg

SEQ ID NO: 3731 - DNA, 23 bp, synthetic construct
  source 1..23: mol_type = other DNA
agatgtacrtcccatcttctggg

SEQ ID NO: 3732 - DNA, 23 bp, synthetic construct
  source 1..23: mol_type = other DNA
cttcatrttctggaaggtaaagg

SEQ ID NO: 3733 - DNA, 23 bp, synthetic construct
  source 1..23: mol_type = other DNA
tcatgtrcaggatggtctccagg

SEQ ID NO: 3734 - DNA, 23 bp, synthetic construct
  source 1..23: mol_type = other DNA
ccccctacaggtttgacyggatg

SEQ ID NO: 3735 - DNA, 23 bp, synthetic construct
  source 1..23: mol_type = other DNA
cccctacaggtttgacyggatgg

SEQ ID NO: 3736 - DNA, 23 bp, synthetic construct
  source 1..23: mol_type = other DNA
ccctacaggtttgacyggatggc

SEQ ID NO: 3737 - DNA, 23 bp, synthetic construct
  source 1..23: mol_type = other DNA
cctacaggtttgacyggatggca

SEQ ID NO: 3738 - DNA, 23 bp, synthetic construct
  source 1..23: mol_type = other DNA
cccaggcgtcccctaycctgggc

SEQ ID NO: 3739 - DNA, 23 bp, synthetic construct
  source 1..23: mol_type = other DNA
ccaggcgtcccctaycctgggct

SEQ ID NO: 3740 - DNA, 23 bp, synthetic construct
  source 1..23: mol_type = other DNA
ccctgggctctcagcgccyaccc

SEQ ID NO: 3741 - DNA, 23 bp, synthetic construct
  source 1..23: mol_type = other DNA
cctgggctctcagcgccyacccc

SEQ ID NO: 3742 - DNA, 23 bp, synthetic construct
  source 1..23: mol_type = other DNA
ccggtttggttctccygagaggt

SEQ ID NO: 3743 - DNA, 23 bp, synthetic construct
  source 1..23: mol_type = other DNA
cctacacacacataccccygcac

SEQ ID NO: 3744 - DNA, 23 bp, synthetic construct
  source 1..23: mol_type = other DNA
ccgcctcatcttctccyggagtc

SEQ ID NO: 3745 - DNA, 23 bp, synthetic construct
  source 1..23: mol_type = other DNA
cctggtgaagcacatcygaagtg

SEQ ID NO: 3746 - DNA, 23 bp, synthetic construct
  source 1..23: mol_type = other DNA
ccaaagagttacatctacygtac

SEQ ID NO: 3747 - DNA, 23 bp, synthetic construct
  source 1..23: mol_type = other DNA
gaaraaaagtttaacgtggatgg

SEQ ID NO: 3748 - DNA, 23 bp, synthetic construct
  source 1..23: mol_type = other DNA
aaatgaaraaaagtttaacgtgg

SEQ ID NO: 3749 - DNA, 23 bp, synthetic construct
  source 1..23: mol_type = other DNA
tgtgtrgcaaatgtcaaaacagg

SEQ ID NO: 3750 - DNA, 23 bp, synthetic construct
  source 1..23: mol_type = other DNA
aaaacagrtaaggaatatgaggg

SEQ ID NO: 3751 - DNA, 23 bp, synthetic construct
  source 1..23: mol_type = other DNA
caaaacagrtaaggaatatgagg

SEQ ID NO: 3752 - DNA, 23 bp, synthetic construct
  source 1..23: mol_type = other DNA
tgtttctaracgtctcgagatgg

SEQ ID NO: 3753 - DNA, 23 bp, synthetic construct
  source 1..23: mol_type = other DNA
cctcacagggcttgyccaatcac

SEQ ID NO: 3754 - DNA, 23 bp, synthetic construct
  source 1..23: mol_type = other DNA
ccattggagaataayttttatta

SEQ ID NO: 3755 - DNA, 23 bp, synthetic construct
  source 1..23: mol_type = other DNA
cctgctcttttggtggttcygta

SEQ ID NO: 3756 - DNA, 23 bp, synthetic construct
  source 1..23: mol_type = other DNA
cctcagatgatgacytccggaga

SEQ ID NO: 3757 - DNA, 23 bp, synthetic construct
  source 1..23: mol_type = other DNA
ggaagrgagtatgtacaggctgg

SEQ ID NO: 3758 - DNA, 23 bp, synthetic construct
  source 1..23: mol_type = other DNA
cctcattacctgaggyaggtaaa

SEQ ID NO: 3759 - DNA, 23 bp, synthetic construct
  source 1..23: mol_type = other DNA
ccaggctcatacagcaaygactt

SEQ ID NO: 3760 - DNA, 23 bp, synthetic construct
  source 1..23: mol_type = other DNA
cagrtctgctggcaggactgtgg

SEQ ID NO: 3761 - DNA, 23 bp, synthetic construct
  source 1..23: mol_type = other DNA
aactcagrtacctggatactggg

SEQ ID NO: 3762 - DNA, 23 bp, synthetic construct
  source 1..23: mol_type = other DNA
caactcagrtacctggatactgg

SEQ ID NO: 3763 - DNA, 23 bp, synthetic construct
  source 1..23: mol_type = other DNA
cccgtttctcttggtcgtaycag

SEQ ID NO: 3764 - DNA, 23 bp, synthetic construct
  source 1..23: mol_type = other DNA
ccgtttctcttggtcgtaycagc

SEQ ID NO: 3765 - DNA, 23 bp, synthetic construct
  source 1..23: mol_type = other DNA
ccaatggctcggacayggcacag

SEQ ID NO: 3766 - DNA, 23 bp, synthetic construct
  source 1..23: mol_type = other DNA
cccagctcccaacactggayagt

SEQ ID NO: 3767 - DNA, 23 bp, synthetic construct
  source 1..23: mol_type = other DNA
ccagctcccaacactggayagtg

SEQ ID NO: 3768 - DNA, 23 bp, synthetic construct
  source 1..23: mol_type = other DNA
cctctcaggtggagyaggaacag

SEQ ID NO: 3769 - DNA, 23 bp, synthetic construct
  source 1..23: mol_type = other DNA
cctctgagacccacaytggggga

SEQ ID NO: 3770 - DNA, 23 bp, synthetic construct
  source 1..23: mol_type = other DNA
cccaaattctgctggtgyagagg

SEQ ID NO: 3771 - DNA, 23 bp, synthetic construct
  source 1..23: mol_type = other DNA
ccaaattctgctggtgyagaggc

SEQ ID NO: 3772 - DNA, 23 bp, synthetic construct
  source 1..23: mol_type = other DNA
ggcrcaggcggtggtggctgtgg

SEQ ID NO: 3773 - DNA, 23 bp, synthetic construct
  source 1..23: mol_type = other DNA
cggcrtgggccacgcctctctgg

SEQ ID NO: 3774 - DNA, 23 bp, synthetic construct
  source 1..23: mol_type = other DNA
ccacggaggttgagccgggyaca

SEQ ID NO: 3775 - DNA, 23 bp, synthetic construct
  source 1..23: mol_type = other DNA
gtcatcrgtgaggccggccgggg

SEQ ID NO: 3776 - DNA, 23 bp, synthetic construct
  source 1..23: mol_type = other DNA
ggtcatcrgtgaggccggccggg

SEQ ID NO: 3777 - DNA, 23 bp, synthetic construct
  source 1..23: mol_type = other DNA
aggtcatcrgtgaggccggccgg

SEQ ID NO: 3778 - DNA, 23 bp, synthetic construct
  source 1..23: mol_type = other DNA
tgagcrgcaggtgcagcctgggg

SEQ ID NO: 3779 - DNA, 23 bp, synthetic construct
  source 1..23: mol_type = other DNA
atgagcrgcaggtgcagcctggg

SEQ ID NO: 3780 - DNA, 23 bp, synthetic construct
  source 1..23: mol_type = other DNA
gatgagcrgcaggtgcagcctgg

SEQ ID NO: 3781 - DNA, 23 bp, synthetic construct
  source 1..23: mol_type = other DNA
ttcctrgttcaagaatggcctgg

SEQ ID NO: 3782 - DNA, 23 bp, synthetic construct
  source 1..23: mol_type = other DNA
ggctargctgaaggacggggtgg

SEQ ID NO: 3783 - DNA, 23 bp, synthetic construct
  source 1..23: mol_type = other DNA
cccggctargctgaaggacgggg

SEQ ID NO: 3784 - DNA, 23 bp, synthetic construct
  source 1..23: mol_type = other DNA
tcatggrtgagcctgctccaggg

SEQ ID NO: 3785 - DNA, 23 bp, synthetic construct
  source 1..23: mol_type = other DNA
ttcatggrtgagcctgctccagg

SEQ ID NO: 3786 - DNA, 23 bp, synthetic construct
  source 1..23: mol_type = other DNA
gtgrcggcccccagagcgcgtgg

SEQ ID NO: 3787 - DNA, 23 bp, synthetic construct
  source 1..23: mol_type = other DNA
tgacgcctrgggtcttaatgtgg

SEQ ID NO: 3788 - DNA, 23 bp, synthetic construct
  source 1..23: mol_type = other DNA
gccccaagrtagggaactttagg

SEQ ID NO: 3789 - DNA, 23 bp, synthetic construct
  source 1..23: mol_type = other DNA
gagtrccgcctggaggtgcgagg

SEQ ID NO: 3790 - DNA, 23 bp, synthetic construct
  source 1..23: mol_type = other DNA
tctgcartgcctcagtgaccagg

SEQ ID NO: 3791 - DNA, 23 bp, synthetic construct
  source 1..23: mol_type = other DNA
tgtccacrgtgagggggccctgg

SEQ ID NO: 3792 - DNA, 23 bp, synthetic construct
  source 1..23: mol_type = other DNA
gggtggcragaagtgtagcacgg

SEQ ID NO: 3793 - DNA, 23 bp, synthetic construct
  source 1..23: mol_type = other DNA
tgcaggrccaccaacttacaggg

SEQ ID NO: 3794 - DNA, 23 bp, synthetic construct
  source 1..23: mol_type = other DNA
ctgcaggrccaccaacttacagg

SEQ ID NO: 3795 - DNA, 23 bp, synthetic construct
  source 1..23: mol_type = other DNA
gggcrgtgagtgtgcagggcagg

SEQ ID NO: 3796 - DNA, 23 bp, synthetic construct
  source 1..23: mol_type = other DNA
catcgggcrgtgagtgtgcaggg

SEQ ID NO: 3797 - DNA, 23 bp, synthetic construct
  source 1..23: mol_type = other DNA
aaagrtgggcctgggacctgagg

SEQ ID NO: 3798 - DNA, 23 bp, synthetic construct
  source 1..23: mol_type = other DNA
cgtgtgrgagatcctacggcagg

SEQ ID NO: 3799 - DNA, 23 bp, synthetic construct
  source 1..23: mol_type = other DNA
ccaggagtrgttcaccgtcttgg

SEQ ID NO: 3800 - DNA, 23 bp, synthetic construct
  source 1..23: mol_type = other DNA
ccargagtggttcaccgtcttgg

SEQ ID NO: 3801 - DNA, 23 bp, synthetic construct
  source 1..23: mol_type = other DNA
ccarctgctgtgtgagaccgagg

SEQ ID NO: 3802 - DNA, 23 bp, synthetic construct
  source 1..23: mol_type = other DNA
agtrggtggctgccctgcagggg

SEQ ID NO: 3803 - DNA, 23 bp, synthetic construct
  source 1..23: mol_type = other DNA
gagtrggtggctgccctgcaggg

SEQ ID NO: 3804 - DNA, 23 bp, synthetic construct
  source 1..23: mol_type = other DNA
agagtrggtggctgccctgcagg

SEQ ID NO: 3805 - DNA, 23 bp, synthetic construct
  source 1..23: mol_type = other DNA
aatrgtgagttccagaagcacgg

SEQ ID NO: 3806 - DNA, 23 bp, synthetic construct
  source 1..23: mol_type = other DNA
tgtgtgrctgaagaatgggaagg

SEQ ID NO: 3807 - DNA, 23 bp, synthetic construct
  source 1..23: mol_type = other DNA
agtgrgtggctgccctgcagggg

SEQ ID NO: 3808 - DNA, 23 bp, synthetic construct
  source 1..23: mol_type = other DNA
gagtgrgtggctgccctgcaggg

SEQ ID NO: 3809 - DNA, 23 bp, synthetic construct
  source 1..23: mol_type = other DNA
agagtgrgtggctgccctgcagg

SEQ ID NO: 3810 - DNA, 23 bp, synthetic construct
  source 1..23: mol_type = other DNA
tcarggcaagccccggcctcagg

SEQ ID NO: 3811 - DNA, 23 bp, synthetic construct
  source 1..23: mol_type = other DNA
ggcagrtgcagcctggggtgggg

SEQ ID NO: 3812 - DNA, 23 bp, synthetic construct
  source 1..23: mol_type = other DNA
cggcagrtgcagcctggggtggg

SEQ ID NO: 3813 - DNA, 23 bp, synthetic construct
  source 1..23: mol_type = other DNA
gcggcagrtgcagcctggggtgg

SEQ ID NO: 3814 - DNA, 23 bp, synthetic construct
  source 1..23: mol_type = other DNA
cagggtgarcctggctggggggg

SEQ ID NO: 3815 - DNA, 23 bp, synthetic construct
  source 1..23: mol_type = other DNA
accrgctccgtggtggtaacagg

SEQ ID NO: 3816 - DNA, 23 bp, synthetic construct
  source 1..23: mol_type = other DNA
ccctgaccatcagcyagtgctca

SEQ ID NO: 3817 - DNA, 23 bp, synthetic construct
  source 1..23: mol_type = other DNA
ccacgctggtgctgyaggttgtt

SEQ ID NO: 3818 - DNA, 23 bp, synthetic construct
  source 1..23: mol_type = other DNA
ccgcatgttcagcaagyagggag

SEQ ID NO: 3819 - DNA, 23 bp, synthetic construct
  source 1..23: mol_type = other DNA
cctgagcagcaaggtgggcyagc

SEQ ID NO: 3820 - DNA, 23 bp, synthetic construct
  source 1..23: mol_type = other DNA
ccctcgatcatgcgccgcgyttc

SEQ ID NO: 3821 - DNA, 23 bp, synthetic construct
  source 1..23: mol_type = other DNA
cctcgatcatgcgccgcgyttca

SEQ ID NO: 3822 - DNA, 23 bp, synthetic construct
  source 1..23: mol_type = other DNA
cccgggtcagctccacccygtcc

SEQ ID NO: 3823 - DNA, 23 bp, synthetic construct
  source 1..23: mol_type = other DNA
ccgggtcagctccacccygtcct

SEQ ID NO: 3824 - DNA, 23 bp, synthetic construct
  source 1..23: mol_type = other DNA
ccagcctcctgaagcygcctgtg

SEQ ID NO: 3825 - DNA, 23 bp, synthetic construct
  source 1..23: mol_type = other DNA
cctggctggaggtggtcggygga

SEQ ID NO: 3826 - DNA, 23 bp, synthetic construct
  source 1..23: mol_type = other DNA
ccggttcaagaaggacgggyaga

SEQ ID NO: 3827 - DNA, 23 bp, synthetic construct
  source 1..23: mol_type = other DNA
ccattgacgacgtcacayctgcc

SEQ ID NO: 3828 - DNA, 23 bp, synthetic construct
  source 1..23: mol_type = other DNA
cctggaccaaagaggggyagccc

SEQ ID NO: 3829 - DNA, 23 bp, synthetic construct
  source 1..23: mol_type = other DNA
cctcttcgtgatgcggccayagg

SEQ ID NO: 3830 - DNA, 23 bp, synthetic construct
  source 1..23: mol_type = other DNA
ccccaagcttcaccyagcccctg

SEQ ID NO: 3831 - DNA, 23 bp, synthetic construct
  source 1..23: mol_type = other DNA
ccaggccattcttgaaycaggaa

SEQ ID NO: 3832 - DNA, 23 bp, synthetic construct
  source 1..23: mol_type = other DNA
ccgcaggtgcgtctggcaygtct

SEQ ID NO: 3833 - DNA, 23 bp, synthetic construct
  source 1..23: mol_type = other DNA
cccggctgcttttcygagtgcgg

SEQ ID NO: 3834 - DNA, 23 bp, synthetic construct
  source 1..23: mol_type = other DNA
gccagcrccgcaacgaccttcgg

SEQ ID NO: 3835 - DNA, 23 bp, synthetic construct
  source 1..23: mol_type = other DNA
gccrgcagggcttccccaaccgg

SEQ ID NO: 3836 - DNA, 23 bp, synthetic construct
  source 1..23: mol_type = other DNA
ccaggagctagaggcccacyttg

SEQ ID NO: 3837 - DNA, 23 bp, synthetic construct
  source 1..23: mol_type = other DNA
cctgcctcaacgaggcctyggtc

SEQ ID NO: 3838 - DNA, 23 bp, synthetic construct
  source 1..23: mol_type = other DNA
cctcaacgaggcctyggtcctgc

SEQ ID NO: 3839 - DNA, 23 bp, synthetic construct
  source 1..23: mol_type = other DNA
ttgggaacrccaagactgtgagg

SEQ ID NO: 3840 - DNA, 23 bp, synthetic construct
  source 1..23: mol_type = other DNA
ccagtccattctgatcaygtaag

SEQ ID NO: 3841 - DNA, 23 bp, synthetic construct
  source 1..23: mol_type = other DNA
ggctcgccrcaaggagctggagg

SEQ ID NO: 3842 - DNA, 23 bp, synthetic construct
  source 1..23: mol_type = other DNA
cctgctgcrgctgcaggacctgg

SEQ ID NO: 3843 - DNA, 23 bp, synthetic construct
  source 1..23: mol_type = other DNA
tcctccrtctgggggccagaggg

SEQ ID NO: 3844 - DNA, 23 bp, synthetic construct
  source 1..23: mol_type = other DNA
ctcctccrtctgggggccagagg

SEQ ID NO: 3845 - DNA, 23 bp, synthetic construct
  source 1..23: mol_type = other DNA
attcattcraattcattttgggg

SEQ ID NO: 3846 - DNA, 23 bp, synthetic construct
  source 1..23: mol_type = other DNA
acaggcrccatcatgcactttgg

SEQ ID NO: 3847 - DNA, 23 bp, synthetic construct
  source 1..23: mol_type = other DNA
tgccactrgggcactggccaagg

SEQ ID NO: 3848 - DNA, 23 bp, synthetic construct
  source 1..23: mol_type = other DNA
cagccacrccagtacttcatagg

SEQ ID NO: 3849 - DNA, 23 bp, synthetic construct
  source 1..23: mol_type = other DNA
gtatcrcatcctgaacccagcgg

SEQ ID NO: 3850 - DNA, 23 bp, synthetic construct
  source 1..23: mol_type = other DNA
ggacrccattcagcggactgagg

SEQ ID NO: 3851 - DNA, 23 bp, synthetic construct
  source 1..23: mol_type = other DNA
agagragctgaagaaggagcagg

SEQ ID NO: 3852 - DNA, 23 bp, synthetic construct
  source 1..23: mol_type = other DNA
gccragcagatcgccctcaaggg

SEQ ID NO: 3853 - DNA, 23 bp, synthetic construct
  source 1..23: mol_type = other DNA
agccragcagatcgccctcaagg

SEQ ID NO: 3854 - DNA, 23 bp, synthetic construct
  source 1..23: mol_type = other DNA
gacgcrcatcaatgccaccctgg

SEQ ID NO: 3855 - DNA, 23 bp, synthetic construct
  source 1..23: mol_type = other DNA
gaacragaggctggaggatgagg

SEQ ID NO: 3856 - DNA, 23 bp, synthetic construct
  source 1..23: mol_type = other DNA
tctacrgggacttccggcagagg

SEQ ID NO: 3857 - DNA, 23 bp, synthetic construct
  source 1..23: mol_type = other DNA
tccrgcagaggtgggtatgaggg

SEQ ID NO: 3858 - DNA, 23 bp, synthetic construct
  source 1..23: mol_type = other DNA
ttccrgcagaggtgggtatgagg

SEQ ID NO: 3859 - DNA, 23 bp, synthetic construct
  source 1..23: mol_type = other DNA
ccagrccaaccctgctctggagg

SEQ ID NO: 3860 - DNA, 23 bp, synthetic construct
  source 1..23: mol_type = other DNA
catccagrccaaccctgctctgg

SEQ ID NO: 3861 - DNA, 23 bp, synthetic construct
  source 1..23: mol_type = other DNA
acgcatcraggagctggaggagg

SEQ ID NO: 3862 - DNA, 23 bp, synthetic construct
  source 1..23: mol_type = other DNA
acagcrgagaatccggagcaggg

SEQ ID NO: 3863 - DNA, 23 bp, synthetic construct
  source 1..23: mol_type = other DNA
cacagcrgagaatccggagcagg

SEQ ID NO: 3864 - DNA, 23 bp, synthetic construct
  source 1..23: mol_type = other DNA
gatgrcagaggagctgaagaagg

SEQ ID NO: 3865 - DNA, 23 bp, synthetic construct
  source 1..23: mol_type = other DNA
tgctraggagaaggccaagaagg

SEQ ID NO: 3866 - DNA, 23 bp, synthetic construct
  source 1..23: mol_type = other DNA
cctggagcgagcgaagyggaagc

SEQ ID NO: 3867 - DNA, 23 bp, synthetic construct
  source 1..23: mol_type = other DNA
cctctacggggacttcyggcaga

SEQ ID NO: 3868 - DNA, 23 bp, synthetic construct
  source 1..23: mol_type = other DNA
cctggcagatgctgaggagygct

SEQ ID NO: 3869 - DNA, 23 bp, synthetic construct
  source 1..23: mol_type = other DNA
cccatccccactttgtaygttgt

SEQ ID NO: 3870 - DNA, 23 bp, synthetic construct
  source 1..23: mol_type = other DNA
ccatccccactttgtaygttgta

SEQ ID NO: 3871 - DNA, 23 bp, synthetic construct
  source 1..23: mol_type = other DNA
cctggtcatgcaccagctgygct

SEQ ID NO: 3872 - DNA, 23 bp, synthetic construct
  source 1..23: mol_type = other DNA
ccaaagaggcaccttctygatga

SEQ ID NO: 3873 - DNA, 23 bp, synthetic construct
  source 1..23: mol_type = other DNA
ccggctggacgaagycgagcaga

SEQ ID NO: 3874 - DNA, 23 bp, synthetic construct
  source 1..23: mol_type = other DNA
ccgtgacattggcaygaaggtgg

SEQ ID NO: 3875 - DNA, 23 bp, synthetic construct
  source 1..23: mol_type = other DNA
cctccagctccttgcggygagcc

SEQ ID NO: 3876 - DNA, 23 bp, synthetic construct
  source 1..23: mol_type = other DNA
ccagctccttgcggygagcctcg

SEQ ID NO: 3877 - DNA, 23 bp, synthetic construct
  source 1..23: mol_type = other DNA
gccrccagggcttccccaacagg

SEQ ID NO: 3878 - DNA, 23 bp, synthetic construct
  source 1..23: mol_type = other DNA
ggcatccrtatctgccgccaggg

SEQ ID NO: 3879 - DNA, 23 bp, synthetic construct
  source 1..23: mol_type = other DNA
gggcatccrtatctgccgccagg

SEQ ID NO: 3880 - DNA, 23 bp, synthetic construct
  source 1..23: mol_type = other DNA
tcggaccragaagaagctgaagg

SEQ ID NO: 3881 - DNA, 23 bp, synthetic construct
  source 1..23: mol_type = other DNA
cctcaacgaagcctyggtgctgc

SEQ ID NO: 3882 - DNA, 23 bp, synthetic construct
  source 1..23: mol_type = other DNA
ccgtttgtcgtgccccgcygaat

SEQ ID NO: 3883 - DNA, 23 bp, synthetic construct
  source 1..23: mol_type = other DNA
ccacgragaagagaaggactagg

SEQ ID NO: 3884 - DNA, 23 bp, synthetic construct
  source 1..23: mol_type = other DNA
ccacrgagaagagaaggactagg

SEQ ID NO: 3885 - DNA, 23 bp, synthetic construct
  source 1..23: mol_type = other DNA
atcgacagrtatcttggttacgg

SEQ ID NO: 3886 - DNA, 23 bp, synthetic construct
  source 1..23: mol_type = other DNA
cagrtgggtcagcaccaggcggg

SEQ ID NO: 3887 - DNA, 23 bp, synthetic construct
  source 1..23: mol_type = other DNA
gcagrtgggtcagcaccaggcgg

SEQ ID NO: 3888 - DNA, 23 bp, synthetic construct
  source 1..23: mol_type = other DNA
gtggcagrtgggtcagcaccagg

SEQ ID NO: 3889 - DNA, 23 bp, synthetic construct
  source 1..23: mol_type = other DNA
ccagrtgaggggggaaggtgggg

SEQ ID NO: 3890 - DNA, 23 bp, synthetic construct
  source 1..23: mol_type = other DNA
cccagrtgaggggggaaggtggg

SEQ ID NO: 3891 - DNA, 23 bp, synthetic construct
  source 1..23: mol_type = other DNA
acccagrtgaggggggaaggtgg

SEQ ID NO: 3892 - DNA, 23 bp, synthetic construct
  source 1..23: mol_type = other DNA
ctgrctgtgtcatcgcaagctgg

SEQ ID NO: 3893 - DNA, 23 bp, synthetic construct
  source 1..23: mol_type = other DNA
ccgctgcatcaagcycaacgatg

SEQ ID NO: 3894 - DNA, 23 bp, synthetic construct
  source 1..23: mol_type = other DNA
tcgccatrgtaagccgggtgcgg

SEQ ID NO: 3895 - DNA, 23 bp, synthetic construct
  source 1..23: mol_type = other DNA
aaagrtgggctggagggaagggg

SEQ ID NO: 3896 - DNA, 23 bp, synthetic construct
  source 1..23: mol_type = other DNA
taaagrtgggctggagggaaggg

SEQ ID NO: 3897 - DNA, 23 bp, synthetic construct
  source 1..23: mol_type = other DNA
gtaaagrtgggctggagggaagg

SEQ ID NO: 3898 - DNA, 23 bp, synthetic construct
  source 1..23: mol_type = other DNA
cacrgacacagccgcccagctgg

SEQ ID NO: 3899 - DNA, 23 bp, synthetic construct
  source 1..23: mol_type = other DNA
cgtgcrcgacgccttcgtaaagg

SEQ ID NO: 3900 - DNA, 23 bp, synthetic construct
  source 1..23: mol_type = other DNA
ccgcaatgacaactcaagcygtt

SEQ ID NO: 3901 - DNA, 23 bp, synthetic construct
  source 1..23: mol_type = other DNA
ccctcactcacctacyaggtgtt

SEQ ID NO: 3902 - DNA, 23 bp, synthetic construct
  source 1..23: mol_type = other DNA
cctcactcacctacyaggtgttc

SEQ ID NO: 3903 - DNA, 23 bp, synthetic construct
  source 1..23: mol_type = other DNA
ccggcacctgtgcgtgcgcyagc

SEQ ID NO: 3904 - DNA, 23 bp, synthetic construct
  source 1..23: mol_type = other DNA
ccatcgactgcctgcaayggctc

SEQ ID NO: 3905 - DNA, 23 bp, synthetic construct
  source 1..23: mol_type = other DNA
ccagcccttctttgtgygatgca

SEQ ID NO: 3906 - DNA, 23 bp, synthetic construct
  source 1..23: mol_type = other DNA
ccggctcttgcagctgygaacgg

SEQ ID NO: 3907 - DNA, 23 bp, synthetic construct
  source 1..23: mol_type = other DNA
cccggaagtaccctcygcacctg

SEQ ID NO: 3908 - DNA, 23 bp, synthetic construct
  source 1..23: mol_type = other DNA
ccggaagtaccctcygcacctgg

SEQ ID NO: 3909 - DNA, 23 bp, synthetic construct
  source 1..23: mol_type = other DNA
aggatrtggagaactagtttggg

SEQ ID NO: 3910 - DNA, 23 bp, synthetic construct
  source 1..23: mol_type = other DNA
caggatrtggagaactagtttgg

SEQ ID NO: 3911 - DNA, 23 bp, synthetic construct
  source 1..23: mol_type = other DNA
ccacggacagttccygtattctt

SEQ ID NO: 3912 - DNA, 23 bp, synthetic construct
  source 1..23: mol_type = other DNA
ccagaccaaacagtcttycatta

SEQ ID NO: 3913 - DNA, 23 bp, synthetic construct
  source 1..23: mol_type = other DNA
tgaggggcrcctctgtcggctgg

SEQ ID NO: 3914 - DNA, 23 bp, synthetic construct
  source 1..23: mol_type = other DNA
tgtcrttttgctgttgaaaaagg

SEQ ID NO: 3915 - DNA, 23 bp, synthetic construct
  source 1..23: mol_type = other DNA
ctctcatcraagtgtacatgcgg

SEQ ID NO: 3916 - DNA, 23 bp, synthetic construct
  source 1..23: mol_type = other DNA
catgcrgcctctgtccaacaagg

SEQ ID NO: 3917 - DNA, 23 bp, synthetic construct
  source 1..23: mol_type = other DNA
ccctcrctggcggcttttcctgg

SEQ ID NO: 3918 - DNA, 23 bp, synthetic construct
  source 1..23: mol_type = other DNA
gccrctaccagctgaccttgtgg

SEQ ID NO: 3919 - DNA, 23 bp, synthetic construct
  source 1..23: mol_type = other DNA
actggcctrgagcggccaggagg

SEQ ID NO: 3920 - DNA, 23 bp, synthetic construct
  source 1..23: mol_type = other DNA
cccgctggtcaggcggcygtccc

SEQ ID NO: 3921 - DNA, 23 bp, synthetic construct
  source 1..23: mol_type = other DNA
ccgctggtcaggcggcygtccct

SEQ ID NO: 3922 - DNA, 23 bp, synthetic construct
  source 1..23: mol_type = other DNA
ccagctttgccgcccggyggtat

SEQ ID NO: 3923 - DNA, 23 bp, synthetic construct
  source 1..23: mol_type = other DNA
cctgctggacctcactyggcagg

SEQ ID NO: 3924 - DNA, 23 bp, synthetic construct
  source 1..23: mol_type = other DNA
ccgggtcctggaccagatgygct

SEQ ID NO: 3925 - DNA, 23 bp, synthetic construct
  source 1..23: mol_type = other DNA
ccattttatagatcytcctgagt

SEQ ID NO: 3926 - DNA, 23 bp, synthetic construct
  source 1..23: mol_type = other DNA
gccttgtrtcttccgtttgacgg

SEQ ID NO: 3927 - DNA, 23 bp, synthetic construct
  source 1..23: mol_type = other DNA
cctgctgcccctgctggagygag

SEQ ID NO: 3928 - DNA, 23 bp, synthetic construct
  source 1..23: mol_type = other DNA
agagtrgctaaggcaggaaatgg

SEQ ID NO: 3929 - DNA, 23 bp, synthetic construct
  source 1..23: mol_type = other DNA
ccttrtgaaaggcttggtcctgg

SEQ ID NO: 3930 - DNA, 23 bp, synthetic construct
  source 1..23: mol_type = other DNA
ccgccgagaaccgcyagggcaca

SEQ ID NO: 3931 - DNA, 23 bp, synthetic construct
  source 1..23: mol_type = other DNA
gttccctcraagctgaatcaagg

SEQ ID NO: 3932 - DNA, 23 bp, synthetic construct
  source 1..23: mol_type = other DNA
gagrtaaggagaacagggcctgg

SEQ ID NO: 3933 - DNA, 23 bp, synthetic construct
  source 1..23: mol_type = other DNA
cctgtgagrtaaggagaacaggg

SEQ ID NO: 3934 - DNA, 23 bp, synthetic construct
  source 1..23: mol_type = other DNA
ccargcctggacgactccaccgg

SEQ ID NO: 3935 - DNA, 23 bp, synthetic construct
  source 1..23: mol_type = other DNA
ccggccccagacttycaagctga

SEQ ID NO: 3936 - DNA, 23 bp, synthetic construct
  source 1..23: mol_type = other DNA
ccacctaccggtacatcytctcc

SEQ ID NO: 3937 - DNA, 23 bp, synthetic construct
  source 1..23: mol_type = other DNA
cctaccggtacatcytctcctgt

SEQ ID NO: 3938 - DNA, 23 bp, synthetic construct
  source 1..23: mol_type = other DNA
cctacatcctaactygatttgct

SEQ ID NO: 3939 - DNA, 23 bp, synthetic construct
  source 1..23: mol_type = other DNA
atcatcrgcccccagaaaacagg

SEQ ID NO: 3940 - DNA, 23 bp, synthetic construct
  source 1..23: mol_type = other DNA
ccctatgcctttactgccyggcc

SEQ ID NO: 3941 - DNA, 23 bp, synthetic construct
  source 1..23: mol_type = other DNA
cctatgcctttactgccyggcct

SEQ ID NO: 3942 - DNA, 23 bp, synthetic construct
  source 1..23: mol_type = other DNA
gttgtrgcggagaagggcagtgg

SEQ ID NO: 3943 - DNA, 23 bp, synthetic construct
  source 1..23: mol_type = other DNA
cgcrctacgtggtctccatgggg

SEQ ID NO: 3944 - DNA, 23 bp, synthetic construct
  source 1..23: mol_type = other DNA
ccgcrctacgtggtctccatggg

SEQ ID NO: 3945 - DNA, 23 bp, synthetic construct
  source 1..23: mol_type = other DNA
gccgcrctacgtggtctccatgg

SEQ ID NO: 3946 - DNA, 23 bp, synthetic construct
  source 1..23: mol_type = other DNA
gctgcrccggtacccatccgggg

SEQ ID NO: 3947 - DNA, 23 bp, synthetic construct
  source 1..23: mol_type = other DNA
cgctgcrccggtacccatccggg

SEQ ID NO: 3948 - DNA, 23 bp, synthetic construct
  source 1..23: mol_type = other DNA
gcgctgcrccggtacccatccgg

SEQ ID NO: 3949 - DNA, 23 bp, synthetic construct
  source 1..23: mol_type = other DNA
cctgttccgggaacyggccacca

SEQ ID NO: 3950 - DNA, 23 bp, synthetic construct
  source 1..23: mol_type = other DNA
ccggccaccatcaactaccygtt

SEQ ID NO: 3951 - DNA, 23 bp, synthetic construct
  source 1..23: mol_type = other DNA
ccaccatcaactaccygttcgag

SEQ ID NO: 3952 - DNA, 23 bp, synthetic construct
  source 1..23: mol_type = other DNA
ccgcgacctgcgcctggyggcgg

SEQ ID NO: 3953 - DNA, 23 bp, synthetic construct
  source 1..23: mol_type = other DNA
cgctacrgaagtggggtcagcgg

SEQ ID NO: 3954 - DNA, 23 bp, synthetic construct
  source 1..23: mol_type = other DNA
ctgrggaggctgtagggtttggg

SEQ ID NO: 3955 - DNA, 23 bp, synthetic construct
  source 1..23: mol_type = other DNA
tctgrggaggctgtagggtttgg

SEQ ID NO: 3956 - DNA, 23 bp, synthetic construct
  source 1..23: mol_type = other DNA
gcctcatcrtgtgtggccatggg

SEQ ID NO: 3957 - DNA, 23 bp, synthetic construct
  source 1..23: mol_type = other DNA
cctccgcagctatgatgyctgtg

SEQ ID NO: 3958 - DNA, 23 bp, synthetic construct
  source 1..23: mol_type = other DNA
ccgcagctatgatgyctgtgata

SEQ ID NO: 3959 - DNA, 23 bp, synthetic construct
  source 1..23: mol_type = other DNA
ccctgagctcgtggacyctgtgg

SEQ ID NO: 3960 - DNA, 23 bp, synthetic construct
  source 1..23: mol_type = other DNA
cctgagctcgtggacyctgtggt

SEQ ID NO: 3961 - DNA, 23 bp, synthetic construct
  source 1..23: mol_type = other DNA
ccccaccacaatacyaaacatct

SEQ ID NO: 3962 - DNA, 23 bp, synthetic construct
  source 1..23: mol_type = other DNA
ccctaaagaaggttgcgyagtta

SEQ ID NO: 3963 - DNA, 23 bp, synthetic construct
  source 1..23: mol_type = other DNA
cctaaagaaggttgcgyagttag

SEQ ID NO: 3964 - DNA, 23 bp, synthetic construct
  source 1..23: mol_type = other DNA
cccccccgatttgcygacaagcc

SEQ ID NO: 3965 - DNA, 23 bp, synthetic construct
  source 1..23: mol_type = other DNA
ccagcggaacctccttyagatga

SEQ ID NO: 3966 - DNA, 23 bp, synthetic construct
  source 1..23: mol_type = other DNA
ccggactctggggctcygagaaa

SEQ ID NO: 3967 - DNA, 23 bp, synthetic construct
  source 1..23: mol_type = other DNA
ccgcagaggctgagyaggaaatg

SEQ ID NO: 3968 - DNA, 23 bp, synthetic construct
  source 1..23: mol_type = other DNA
cccgtggaatgaaatcygaaaca

SEQ ID NO: 3969 - DNA, 23 bp, synthetic construct
  source 1..23: mol_type = other DNA
ccgtggaatgaaatcygaaacat

SEQ ID NO: 3970 - DNA, 23 bp, synthetic construct
  source 1..23: mol_type = other DNA
cctgcagaatccggayaatcaga

SEQ ID NO: 3971 - DNA, 23 bp, synthetic construct
  source 1..23: mol_type = other DNA
ccttcttattacagatygattga

SEQ ID NO: 3972 - DNA, 23 bp, synthetic construct
  source 1..23: mol_type = other DNA
ccgccgccgcccttgyagccgcc

SEQ ID NO: 3973 - DNA, 23 bp, synthetic construct
  source 1..23: mol_type = other DNA
gttcagrtaagcatgttttatgg

SEQ ID NO: 3974 - DNA, 23 bp, synthetic construct
  source 1..23: mol_type = other DNA
ccttctctttaatgcaygaatag

SEQ ID NO: 3975 - DNA, 23 bp, synthetic construct
  source 1..23: mol_type = other DNA
cctcggttaaaatcagaaygagc

SEQ ID NO: 3976 - DNA, 23 bp, synthetic construct
  source 1..23: mol_type = other DNA
ccacctttaatcctayaatctca

SEQ ID NO: 3977 - DNA, 23 bp, synthetic construct
  source 1..23: mol_type = other DNA
ccttgttcatcacctygagatgt

SEQ ID NO: 3978 - DNA, 23 bp, synthetic construct
  source 1..23: mol_type = other DNA
ccgctacaaaatgaagcgcyagg

SEQ ID NO: 3979 - DNA, 23 bp, synthetic construct
  source 1..23: mol_type = other DNA
cctggaacagcagcagygcagcc

SEQ ID NO: 3980 - DNA, 23 bp, synthetic construct
  source 1..23: mol_type = other DNA
ccagcgtgctgaaactcaygtcc

SEQ ID NO: 3981 - DNA, 23 bp, synthetic construct
  source 1..23: mol_type = other DNA
cccccgaacgcgacyagctggcc

SEQ ID NO: 3982 - DNA, 23 bp, synthetic construct
  source 1..23: mol_type = other DNA
ccgcctgcccgcaggatcgyggt

SEQ ID NO: 3983 - DNA, 23 bp, synthetic construct
  source 1..23: mol_type = other DNA
cctgcccgcaggatcgyggtgcc

SEQ ID NO: 3984 - DNA, 23 bp, synthetic construct
  source 1..23: mol_type = other DNA
ccgccgccgccgcctgccygcag

SEQ ID NO: 3985 - DNA, 23 bp, synthetic construct
  source 1..23: mol_type = other DNA
ccgccgccgcctgccygcaggat

SEQ ID NO: 3986 - DNA, 23 bp, synthetic construct
  source 1..23: mol_type = other DNA
cctctccaggagctcatcygagt

SEQ ID NO: 3987 - DNA, 23 bp, synthetic construct
  source 1..23: mol_type = other DNA
ccaagaccaccaccgyggtgtac

SEQ ID NO: 3988 - DNA, 23 bp, synthetic construct
  source 1..23: mol_type = other DNA
ccacgagacctgtggycctggag

SEQ ID NO: 3989 - DNA, 23 bp, synthetic construct
  source 1..23: mol_type = other DNA
acagctctragagtgaagacagg

SEQ ID NO: 3990 - DNA, 23 bp, synthetic construct
  source 1..23: mol_type = other DNA
gaartggttctccttgcttgtgg

SEQ ID NO: 3991 - DNA, 23 bp, synthetic construct
  source 1..23: mol_type = other DNA
cctgacagtgataaacgcygaga

SEQ ID NO: 3992 - DNA, 23 bp, synthetic construct
  source 1..23: mol_type = other DNA
ctgccrgcagctgcagtgcatgg

SEQ ID NO: 3993 - DNA, 23 bp, synthetic construct
  source 1..23: mol_type = other DNA
cccggggtggcggaccgcytcat

SEQ ID NO: 3994 - DNA, 23 bp, synthetic construct
  source 1..23: mol_type = other DNA
ccggggtggcggaccgcytcatc

SEQ ID NO: 3995 - DNA, 23 bp, synthetic construct
  source 1..23: mol_type = other DNA
acctgatcrgatggggctcctgg

SEQ ID NO: 3996 - DNA, 23 bp, synthetic construct
  source 1..23: mol_type = other DNA
cgctcgtrctccgtgcccgaggg

SEQ ID NO: 3997 - DNA, 23 bp, synthetic construct
  source 1..23: mol_type = other DNA
gcgctcgtrctccgtgcccgagg

SEQ ID NO: 3998 - DNA, 23 bp, synthetic construct
  source 1..23: mol_type = other DNA
ccatcatgcatgcgggcatycag

SEQ ID NO: 3999 - DNA, 23 bp, synthetic construct
  source 1..23: mol_type = other DNA
gctgcccrcctggctgtggaggg

SEQ ID NO: 4000 - DNA, 23 bp, synthetic construct
  source 1..23: mol_type = other DNA
ggctgcccrcctggctgtggagg

SEQ ID NO: 4001 - DNA, 23 bp, synthetic construct
  source 1..23: mol_type = other DNA
gagtrtctgaagggttatgcagg

SEQ ID NO: 4002 - DNA, 23 bp, synthetic construct
  source 1..23: mol_type = other DNA
cccctgatcctggctgccygcct

SEQ ID NO: 4003 - DNA, 23 bp, synthetic construct
  source 1..23: mol_type = other DNA
ccctgatcctggctgccygcctg

SEQ ID NO: 4004 - DNA, 23 bp, synthetic construct
  source 1..23: mol_type = other DNA
cctgatcctggctgccygcctgg

SEQ ID NO: 4005 - DNA, 23 bp, synthetic construct
  source 1..23: mol_type = other DNA
ccctaaaggcagtattgccyaac

SEQ ID NO: 4006 - DNA, 23 bp, synthetic construct
  source 1..23: mol_type = other DNA
cctaaaggcagtattgccyaacc

SEQ ID NO: 4007 - DNA, 23 bp, synthetic construct
  source 1..23: mol_type = other DNA
ccccacacccccttcayagcaca

SEQ ID NO: 4008 - DNA, 23 bp, synthetic construct
  source 1..23: mol_type = other DNA
cccacacccccttcayagcacag

SEQ ID NO: 4009 - DNA, 23 bp, synthetic construct
  source 1..23: mol_type = other DNA
ccacacccccttcayagcacagt

SEQ ID NO: 4010 - DNA, 23 bp, synthetic construct
  source 1..23: mol_type = other DNA
ccgggtgggtgagccctgcygcc

SEQ ID NO: 4011 - DNA, 23 bp, synthetic construct
  source 1..23: mol_type = other DNA
ccacctgccatgacygcgtggct

SEQ ID NO: 4012 - DNA, 23 bp, synthetic construct
  source 1..23: mol_type = other DNA
gcctrtgtactttgtcctggagg

SEQ ID NO: 4013 - DNA, 23 bp, synthetic construct
  source 1..23: mol_type = other DNA
tccgcctrtgtactttgtcctgg

SEQ ID NO: 4014 - DNA, 23 bp, synthetic construct
  source 1..23: mol_type = other DNA
ttaaacrtcaagaggtaagttgg

SEQ ID NO: 4015 - DNA, 23 bp, synthetic construct
  source 1..23: mol_type = other DNA
ccagtgaaaagcgaatatycctc

SEQ ID NO: 4016 - DNA, 23 bp, synthetic construct
  source 1..23: mol_type = other DNA
cccccagatagacttaygatctg

SEQ ID NO: 4017 - DNA, 23 bp, synthetic construct
  source 1..23: mol_type = other DNA
ccccagatagacttaygatctgt

SEQ ID NO: 4018 - DNA, 23 bp, synthetic construct
  source 1..23: mol_type = other DNA
cccagatagacttaygatctgta

SEQ ID NO: 4019 - DNA, 23 bp, synthetic construct
  source 1..23: mol_type = other DNA
cccacccgcaacgacgccaygac

SEQ ID NO: 4020 - DNA, 23 bp, synthetic construct
  source 1..23: mol_type = other DNA
ccacccgcaacgacgccaygact

SEQ ID NO: 4021 - DNA, 23 bp, synthetic construct
  source 1..23: mol_type = other DNA
cccgcaacgacgccaygactgca

SEQ ID NO: 4022 - DNA, 23 bp, synthetic construct
  source 1..23: mol_type = other DNA
ccgcaacgacgccaygactgcag

SEQ ID NO: 4023 - DNA, 23 bp, synthetic construct
  source 1..23: mol_type = other DNA
ccaaggccggccggctgtgyagg

SEQ ID NO: 4024 - DNA, 23 bp, synthetic construct
  source 1..23: mol_type = other DNA
tggattragggtcccccagaggg

SEQ ID NO: 4025 - DNA, 23 bp, synthetic construct
  source 1..23: mol_type = other DNA
gtggattragggtcccccagagg

SEQ ID NO: 4026 - DNA, 23 bp, synthetic construct
  source 1..23: mol_type = other DNA
ccctgctgcctctgtggccygct

SEQ ID NO: 4027 - DNA, 23 bp, synthetic construct
  source 1..23: mol_type = other DNA
cctgctgcctctgtggccygctt

SEQ ID NO: 4028 - DNA, 23 bp, synthetic construct
  source 1..23: mol_type = other DNA
ccctrgtgggacacctcctctgg

SEQ ID NO: 4029 - DNA, 23 bp, synthetic construct
  source 1..23: mol_type = other DNA
ccagacgtgccgggcctgyagtg

SEQ ID NO: 4030 - DNA, 23 bp, synthetic construct
  source 1..23: mol_type = other DNA
tcggttccrggcattggcggtgg

SEQ ID NO: 4031 - DNA, 23 bp, synthetic construct
  source 1..23: mol_type = other DNA
tacrgcggaggctcatctacagg

SEQ ID NO: 4032 - DNA, 23 bp, synthetic construct
  source 1..23: mol_type = other DNA
tcaggaraggggagatgtgatgg

SEQ ID NO: 4033 - DNA, 23 bp, synthetic construct
  source 1..23: mol_type = other DNA
tggaargtaaatgttcatgtggg

SEQ ID NO: 4034 - DNA, 23 bp, synthetic construct
  source 1..23: mol_type = other DNA
gtggaargtaaatgttcatgtgg

SEQ ID NO: 4035 - DNA, 23 bp, synthetic construct
  source 1..23: mol_type = other DNA
ccttgagctggagatygtacaaa

SEQ ID NO: 4036 - DNA, 23 bp, synthetic construct
  source 1..23: mol_type = other DNA
gtgccccrtgtgcggggacaagg

SEQ ID NO: 4037 - DNA, 23 bp, synthetic construct
  source 1..23: mol_type = other DNA
ggggtrgccggaacaagtttggg

SEQ ID NO: 4038 - DNA, 23 bp, synthetic construct
  source 1..23: mol_type = other DNA
aggggtrgccggaacaagtttgg

SEQ ID NO: 4039 - DNA, 23 bp, synthetic construct
  source 1..23: mol_type = other DNA
ggcgggrgcacccccatcggggg

SEQ ID NO: 4040 - DNA, 23 bp, synthetic construct
  source 1..23: mol_type = other DNA
cggcgggrgcacccccatcgggg

SEQ ID NO: 4041 - DNA, 23 bp, synthetic construct
  source 1..23: mol_type = other DNA
gcggcgggrgcacccccatcggg

SEQ ID NO: 4042 - DNA, 23 bp, synthetic construct
  source 1..23: mol_type = other DNA
catrgactattcgtacgacgagg

SEQ ID NO: 4043 - DNA, 23 bp, synthetic construct
  source 1..23: mol_type = other DNA
ccgatgggggtgcccccgcygcc

SEQ ID NO: 4044 - DNA, 23 bp, synthetic construct
  source 1..23: mol_type = other DNA
aaagrtatggatttcttatgtgg

SEQ ID NO: 4045 - DNA, 23 bp, synthetic construct
  source 1..23: mol_type = other DNA
ggcccragtcttcccttacatgg

SEQ ID NO: 4046 - DNA, 23 bp, synthetic construct
  source 1..23: mol_type = other DNA
agtaaatrggaagccagtgttgg

SEQ ID NO: 4047 - DNA, 23 bp, synthetic construct
  source 1..23: mol_type = other DNA
taggaccraatcattgatgctgg

SEQ ID NO: 4048 - DNA, 23 bp, synthetic construct
  source 1..23: mol_type = other DNA
cccctaggcggggctgcygaaat

SEQ ID NO: 4049 - DNA, 23 bp, synthetic construct
  source 1..23: mol_type = other DNA
ccctaggcggggctgcygaaatc

SEQ ID NO: 4050 - DNA, 23 bp, synthetic construct
  source 1..23: mol_type = other DNA
cctaggcggggctgcygaaatca

SEQ ID NO: 4051 - DNA, 23 bp, synthetic construct
  source 1..23: mol_type = other DNA
ccttctagcccgaggtygatcta

SEQ ID NO: 4052 - DNA, 23 bp, synthetic construct
  source 1..23: mol_type = other DNA
ccaaggaagcgaaaaygacagag

SEQ ID NO: 4053 - DNA, 23 bp, synthetic construct
  source 1..23: mol_type = other DNA
cccaaaaagagctaagayagctg

SEQ ID NO: 4054 - DNA, 23 bp, synthetic construct
  source 1..23: mol_type = other DNA
ccaaaaagagctaagayagctgc

SEQ ID NO: 4055 - DNA, 23 bp, synthetic construct
  source 1..23: mol_type = other DNA
cccaaaggaaactatgctyggtt

SEQ ID NO: 4056 - DNA, 23 bp, synthetic construct
  source 1..23: mol_type = other DNA
ccaaaggaaactatgctyggttc

SEQ ID NO: 4057 - DNA, 23 bp, synthetic construct
  source 1..23: mol_type = other DNA
ccttttgtaagcagcatygagaa

SEQ ID NO: 4058 - DNA, 23 bp, synthetic construct
  source 1..23: mol_type = other DNA
ccttcatccaaattgygagatgc

SEQ ID NO: 4059 - DNA, 23 bp, synthetic construct
  source 1..23: mol_type = other DNA
cctttccccgccatcygcataag

SEQ ID NO: 4060 - DNA, 23 bp, synthetic construct
  source 1..23: mol_type = other DNA
ttctcracgatactttttcaggg

SEQ ID NO: 4061 - DNA, 23 bp, synthetic construct
  source 1..23: mol_type = other DNA
cttctcracgatactttttcagg

SEQ ID NO: 4062 - DNA, 23 bp, synthetic construct
  source 1..23: mol_type = other DNA
cagtcctrgggctcccagactgg

SEQ ID NO: 4063 - DNA, 23 bp, synthetic construct
  source 1..23: mol_type = other DNA
agctggrggagggcgcctttggg

SEQ ID NO: 4064 - DNA, 23 bp, synthetic construct
  source 1..23: mol_type = other DNA
gagctggrggagggcgcctttgg

SEQ ID NO: 4065 - DNA, 23 bp, synthetic construct
  source 1..23: mol_type = other DNA
cccattcgctggatgcygcccga

SEQ ID NO: 4066 - DNA, 23 bp, synthetic construct
  source 1..23: mol_type = other DNA
ccattcgctggatgcygcccgag

SEQ ID NO: 4067 - DNA, 23 bp, synthetic construct
  source 1..23: mol_type = other DNA
agggactrgatggagggctccgg

SEQ ID NO: 4068 - DNA, 23 bp, synthetic construct
  source 1..23: mol_type = other DNA
ggccaraactggtagatggctgg

SEQ ID NO: 4069 - DNA, 23 bp, synthetic construct
  source 1..23: mol_type = other DNA
ccattaagccaggggagyatggg

SEQ ID NO: 4070 - DNA, 23 bp, synthetic construct
  source 1..23: mol_type = other DNA
ccttccaggggtcaccygagagg

SEQ ID NO: 4071 - DNA, 23 bp, synthetic construct
  source 1..23: mol_type = other DNA
aggagctrccactgccatcgggg

SEQ ID NO: 4072 - DNA, 23 bp, synthetic construct
  source 1..23: mol_type = other DNA
gaggagctrccactgccatcggg

SEQ ID NO: 4073 - DNA, 23 bp, synthetic construct
  source 1..23: mol_type = other DNA
ccctgattgacaacatccygttc

SEQ ID NO: 4074 - DNA, 23 bp, synthetic construct
  source 1..23: mol_type = other DNA
cctgattgacaacatccygttca

SEQ ID NO: 4075 - DNA, 23 bp, synthetic construct
  source 1..23: mol_type = other DNA
cccaggtgaccatcgygacggcc

SEQ ID NO: 4076 - DNA, 23 bp, synthetic construct
  source 1..23: mol_type = other DNA
ccaggtgaccatcgygacggcca

SEQ ID NO: 4077 - DNA, 23 bp, synthetic construct
  source 1..23: mol_type = other DNA
tgtgaccraattctttggagagg

SEQ ID NO: 4078 - DNA, 23 bp, synthetic construct
  source 1..23: mol_type = other DNA
atcractgattgaagatgaaagg

SEQ ID NO: 4079 - DNA, 23 bp, synthetic construct
  source 1..23: mol_type = other DNA
ccctcttaataggcgcctytaac

SEQ ID NO: 4080 - DNA, 23 bp, synthetic construct
  source 1..23: mol_type = other DNA
cctcttaataggcgcctytaact

SEQ ID NO: 4081 - DNA, 23 bp, synthetic construct
  source 1..23: mol_type = other DNA
ccttcttaggcctagctyagccg

SEQ ID NO: 4082 - DNA, 23 bp, synthetic construct
  source 1..23: mol_type = other DNA
tgctgraaagactagtgtgttgg

SEQ ID NO: 4083 - DNA, 23 bp, synthetic construct
  source 1..23: mol_type = other DNA
ccattgtaacctttgtygaagag

SEQ ID NO: 4084 - DNA, 23 bp, synthetic construct
  source 1..23: mol_type = other DNA
ccaaaggcccccaggatgayatc

SEQ ID NO: 4085 - DNA, 23 bp, synthetic construct
  source 1..23: mol_type = other DNA
ttcgrgaagaaggttgacgatgg

SEQ ID NO: 4086 - DNA, 23 bp, synthetic construct
  source 1..23: mol_type = other DNA
ccaagtgtggctggccatcygag

SEQ ID NO: 4087 - DNA, 23 bp, synthetic construct
  source 1..23: mol_type = other DNA
accragaaccaccagctgaaagg

SEQ ID NO: 4088 - DNA, 23 bp, synthetic construct
  source 1..23: mol_type = other DNA
ccaccatcatggtgcycttcggc

SEQ ID NO: 4089 - DNA, 23 bp, synthetic construct
  source 1..23: mol_type = other DNA
cctgtgcaccaggcttcyggccc

SEQ ID NO: 4090 - DNA, 23 bp, synthetic construct
  source 1..23: mol_type = other DNA
gtagrctttgcacttctgggagg

SEQ ID NO: 4091 - DNA, 23 bp, synthetic construct
  source 1..23: mol_type = other DNA
attgtagrctttgcacttctggg

SEQ ID NO: 4092 - DNA, 23 bp, synthetic construct
  source 1..23: mol_type = other DNA
tattgtagrctttgcacttctgg

SEQ ID NO: 4093 - DNA, 23 bp, synthetic construct
  source 1..23: mol_type = other DNA
agaagatrctgtttaatctgagg

SEQ ID NO: 4094 - DNA, 23 bp, synthetic construct
  source 1..23: mol_type = other DNA
taartgatggtcagagacttggg

SEQ ID NO: 4095 - DNA, 23 bp, synthetic construct
  source 1..23: mol_type = other DNA
gtaartgatggtcagagacttgg

SEQ ID NO: 4096 - DNA, 23 bp, synthetic construct
  source 1..23: mol_type = other DNA
atgatgarcgcagcgaaattcgg

SEQ ID NO: 4097 - DNA, 23 bp, synthetic construct
  source 1..23: mol_type = other DNA
acaracacttggataagcatggg

SEQ ID NO: 4098 - DNA, 23 bp, synthetic construct
  source 1..23: mol_type = other DNA
tacaracacttggataagcatgg

SEQ ID NO: 4099 - DNA, 23 bp, synthetic construct
  source 1..23: mol_type = other DNA
ccgtgaccttctcaytctaaaaa

SEQ ID NO: 4100 - DNA, 23 bp, synthetic construct
  source 1..23: mol_type = other DNA
ccacagtgtattgtytagcatgg

SEQ ID NO: 4101 - DNA, 23 bp, synthetic construct
  source 1..23: mol_type = other DNA
cctggctgattacctcaygctcc

SEQ ID NO: 4102 - DNA, 23 bp, synthetic construct
  source 1..23: mol_type = other DNA
ccttcaggcagctactcyaaagg

SEQ ID NO: 4103 - DNA, 23 bp, synthetic construct
  source 1..23: mol_type = other DNA
gatggrcgcactgctggctgggg

SEQ ID NO: 4104 - DNA, 23 bp, synthetic construct
  source 1..23: mol_type = other DNA
agatggrcgcactgctggctggg

SEQ ID NO: 4105 - DNA, 23 bp, synthetic construct
  source 1..23: mol_type = other DNA
cagatggrcgcactgctggctgg

SEQ ID NO: 4106 - DNA, 23 bp, synthetic construct
  source 1..23: mol_type = other DNA
cctcttggctgcactcycgtaag

SEQ ID NO: 4107 - DNA, 23 bp, synthetic construct
  source 1..23: mol_type = other DNA
tctctttgragccttcctggagg

SEQ ID NO: 4108 - DNA, 23 bp, synthetic construct
  source 1..23: mol_type = other DNA
agcrcctcaagtcctgcatgagg

SEQ ID NO: 4109 - DNA, 23 bp, synthetic construct
  source 1..23: mol_type = other DNA
gagrtgagggcctgggaggaggg

SEQ ID NO: 4110 - DNA, 23 bp, synthetic construct
  source 1..23: mol_type = other DNA
agagrtgagggcctgggaggagg

SEQ ID NO: 4111 - DNA, 23 bp, synthetic construct
  source 1..23: mol_type = other DNA
cacagagrtgagggcctgggagg

SEQ ID NO: 4112 - DNA, 23 bp, synthetic construct
  source 1..23: mol_type = other DNA
cgggccrgctggagtatgaaggg

SEQ ID NO: 4113 - DNA, 23 bp, synthetic construct
  source 1..23: mol_type = other DNA
tcgggccrgctggagtatgaagg

SEQ ID NO: 4114 - DNA, 23 bp, synthetic construct
  source 1..23: mol_type = other DNA
actcrgtacttgctgagcacggg

SEQ ID NO: 4115 - DNA, 23 bp, synthetic construct
  source 1..23: mol_type = other DNA
cactcrgtacttgctgagcacgg

SEQ ID NO: 4116 - DNA, 23 bp, synthetic construct
  source 1..23: mol_type = other DNA
ccaggaggtcaaggcagccyagg

SEQ ID NO: 4117 - DNA, 23 bp, synthetic construct
  source 1..23: mol_type = other DNA
ccggtgctcaatcttccytgacc

SEQ ID NO: 4118 - DNA, 23 bp, synthetic construct
  source 1..23: mol_type = other DNA
cccragtcgagggtgcaggtagg

SEQ ID NO: 4119 - DNA, 23 bp, synthetic construct
  source 1..23: mol_type = other DNA
cttgcccragtcgagggtgcagg

SEQ ID NO: 4120 - DNA, 23 bp, synthetic construct
  source 1..23: mol_type = other DNA
gggcatagraatccctctcctgg

SEQ ID NO: 4121 - DNA, 23 bp, synthetic construct
  source 1..23: mol_type = other DNA
gagcagraaacgtgattttcagg

SEQ ID NO: 4122 - DNA, 23 bp, synthetic construct
  source 1..23: mol_type = other DNA
ccaaaaccrtggcaccatcaggg

SEQ ID NO: 4123 - DNA, 23 bp, synthetic construct
  source 1..23: mol_type = other DNA
ctcgagcrggtgagagcagctgg

SEQ ID NO: 4124 - DNA, 23 bp, synthetic construct
  source 1..23: mol_type = other DNA
ccaaggagtaccgacagygaagc

SEQ ID NO: 4125 - DNA, 23 bp, synthetic construct
  source 1..23: mol_type = other DNA
caggtgtgrgattatgagactgg

SEQ ID NO: 4126 - DNA, 23 bp, synthetic construct
  source 1..23: mol_type = other DNA
cctcttggtcagaaaygagaccc

SEQ ID NO: 4127 - DNA, 23 bp, synthetic construct
  source 1..23: mol_type = other DNA
aaarcaggccagccacaggtcgg

SEQ ID NO: 4128 - DNA, 23 bp, synthetic construct
  source 1..23: mol_type = other DNA
gaggaaarcaggccagccacagg

SEQ ID NO: 4129 - DNA, 23 bp, synthetic construct
  source 1..23: mol_type = other DNA
gctacracccatacacccaaagg

SEQ ID NO: 4130 - DNA, 23 bp, synthetic construct
  source 1..23: mol_type = other DNA
tcctctcrggatttcttgggtgg

SEQ ID NO: 4131 - DNA, 23 bp, synthetic construct
  source 1..23: mol_type = other DNA
cagcatrtccactgcggtcctgg

SEQ ID NO: 4132 - DNA, 23 bp, synthetic construct
  source 1..23: mol_type = other DNA
actrgtttactgtggagtttggg

SEQ ID NO: 4133 - DNA, 23 bp, synthetic construct
  source 1..23: mol_type = other DNA
tactrgtttactgtggagtttgg

SEQ ID NO: 4134 - DNA, 23 bp, synthetic construct
  source 1..23: mol_type = other DNA
attacagrtatgaccttcacagg

SEQ ID NO: 4135 - DNA, 23 bp, synthetic construct
  source 1..23: mol_type = other DNA
ccaaaattacactgtcayggagt

SEQ ID NO: 4136 - DNA, 23 bp, synthetic construct
  source 1..23: mol_type = other DNA
cccagcttgcactggtttcygcc

SEQ ID NO: 4137 - DNA, 23 bp, synthetic construct
  source 1..23: mol_type = other DNA
ccagcttgcactggtttcygcct

SEQ ID NO: 4138 - DNA, 23 bp, synthetic construct
  source 1..23: mol_type = other DNA
cccatgtatacccccgaacygtg

SEQ ID NO: 4139 - DNA, 23 bp, synthetic construct
  source 1..23: mol_type = other DNA
ccatgtatacccccgaacygtga

SEQ ID NO: 4140 - DNA, 23 bp, synthetic construct
  source 1..23: mol_type = other DNA
cctgagcaaagtaaaygaagcac

SEQ ID NO: 4141 - DNA, 23 bp, synthetic construct
  source 1..23: mol_type = other DNA
ggaaaargtgccgggggtgcggg

SEQ ID NO: 4142 - DNA, 23 bp, synthetic construct
  source 1..23: mol_type = other DNA
aggaaaargtgccgggggtgcgg

SEQ ID NO: 4143 - DNA, 23 bp, synthetic construct
  source 1..23: mol_type = other DNA
agtgrgaaaaactttatacctgg

SEQ ID NO: 4144 - DNA, 23 bp, synthetic construct
  source 1..23: mol_type = other DNA
atttrgtaagctttccctctagg

SEQ ID NO: 4145 - DNA, 23 bp, synthetic construct
  source 1..23: mol_type = other DNA
aacattrgtcttttgtgaaatgg

SEQ ID NO: 4146 - DNA, 23 bp, synthetic construct
  source 1..23: mol_type = other DNA
ccctttctgatcaayaagtagaa

SEQ ID NO: 4147 - DNA, 23 bp, synthetic construct
  source 1..23: mol_type = other DNA
ccaaactcgcaaagcyagcatac

SEQ ID NO: 4148 - DNA, 23 bp, synthetic construct
  source 1..23: mol_type = other DNA
ccagcaaatgaaaacyaaaactt

SEQ ID NO: 4149 - DNA, 23 bp, synthetic construct
  source 1..23: mol_type = other DNA
ccagtgatactaaayaattcgac

SEQ ID NO: 4150 - DNA, 23 bp, synthetic construct
  source 1..23: mol_type = other DNA
cctgactctgtgtggaygcaaag

SEQ ID NO: 4151 - DNA, 23 bp, synthetic construct
  source 1..23: mol_type = other DNA
agtrgaaccgcgtctgcatgggg

SEQ ID NO: 4152 - DNA, 23 bp, synthetic construct
  source 1..23: mol_type = other DNA
gagtrgaaccgcgtctgcatggg

SEQ ID NO: 4153 - DNA, 23 bp, synthetic construct
  source 1..23: mol_type = other DNA
cgagtrgaaccgcgtctgcatgg

SEQ ID NO: 4154 - DNA, 23 bp, synthetic construct
  source 1..23: mol_type = other DNA
gagaccrgcagcatcaagccggg

SEQ ID NO: 4155 - DNA, 23 bp, synthetic construct
  source 1..23: mol_type = other DNA
cgagaccrgcagcatcaagccgg

SEQ ID NO: 4156 - DNA, 23 bp, synthetic construct
  source 1..23: mol_type = other DNA
cccacggctgcgtctycaagatc

SEQ ID NO: 4157 - DNA, 23 bp, synthetic construct
  source 1..23: mol_type = other DNA
ccacggctgcgtctycaagatcc

SEQ ID NO: 4158 - DNA, 23 bp, synthetic construct
  source 1..23: mol_type = other DNA
ccacccagggaccggccacygga

SEQ ID NO: 4159 - DNA, 23 bp, synthetic construct
  source 1..23: mol_type = other DNA
cccagggaccggccacyggaatc

SEQ ID NO: 4160 - DNA, 23 bp, synthetic construct
  source 1..23: mol_type = other DNA
ccagggaccggccacyggaatcg

SEQ ID NO: 4161 - DNA, 23 bp, synthetic construct
  source 1..23: mol_type = other DNA
ggtatgrttttctaatcgaaggg

SEQ ID NO: 4162 - DNA, 23 bp, synthetic construct
  source 1..23: mol_type = other DNA
aggtatgrttttctaatcgaagg

SEQ ID NO: 4163 - DNA, 23 bp, synthetic construct
  source 1..23: mol_type = other DNA
cctggctagcgaaaagcaayaga

SEQ ID NO: 4164 - DNA, 23 bp, synthetic construct
  source 1..23: mol_type = other DNA
ccagatgtgtttgccygagaaag

SEQ ID NO: 4165 - DNA, 23 bp, synthetic construct
  source 1..23: mol_type = other DNA
ccgctgcccaacgccatcyggct

SEQ ID NO: 4166 - DNA, 23 bp, synthetic construct
  source 1..23: mol_type = other DNA
cccttgcggagttcygcgtccga

SEQ ID NO: 4167 - DNA, 23 bp, synthetic construct
  source 1..23: mol_type = other DNA
ccaggtttatgtccygttctgaa

SEQ ID NO: 4168 - DNA, 23 bp, synthetic construct
  source 1..23: mol_type = other DNA
ccacatcacgctgagcayccatg

SEQ ID NO: 4169 - DNA, 23 bp, synthetic construct
  source 1..23: mol_type = other DNA
cctggccagcttcatcgaayaag

SEQ ID NO: 4170 - DNA, 23 bp, synthetic construct
  source 1..23: mol_type = other DNA
ccagcttcatcgaayaagtagca

SEQ ID NO: 4171 - DNA, 23 bp, synthetic construct
  source 1..23: mol_type = other DNA
ccaaraaggagtggagtctttgg

SEQ ID NO: 4172 - DNA, 23 bp, synthetic construct
  source 1..23: mol_type = other DNA
acaagcgartgagtcctgagggg

SEQ ID NO: 4173 - DNA, 23 bp, synthetic construct
  source 1..23: mol_type = other DNA
aatrgcggcggcattacgggtgg

SEQ ID NO: 4174 - DNA, 23 bp, synthetic construct
  source 1..23: mol_type = other DNA
aaaaatrgcggcggcattacggg

SEQ ID NO: 4175 - DNA, 23 bp, synthetic construct
  source 1..23: mol_type = other DNA
caaaaatrgcggcggcattacgg

SEQ ID NO: 4176 - DNA, 23 bp, synthetic construct
  source 1..23: mol_type = other DNA
cctgttcatcactggccytgatg

SEQ ID NO: 4177 - DNA, 23 bp, synthetic construct
  source 1..23: mol_type = other DNA
ccctttccctgcagcagtgygag

SEQ ID NO: 4178 - DNA, 23 bp, synthetic construct
  source 1..23: mol_type = other DNA
cctttccctgcagcagtgygagg

SEQ ID NO: 4179 - DNA, 23 bp, synthetic construct
  source 1..23: mol_type = other DNA
ccaaccttcttccacaygtgccc

SEQ ID NO: 4180 - DNA, 23 bp, synthetic construct
  source 1..23: mol_type = other DNA
cctgctggtcaccaagyagaaga

SEQ ID NO: 4181 - DNA, 23 bp, synthetic construct
  source 1..23: mol_type = other DNA
ccaatgacaatccgcyggtcatc

SEQ ID NO: 4182 - DNA, 23 bp, synthetic construct
  source 1..23: mol_type = other DNA
cccgagctgcagtggctcygagc

SEQ ID NO: 4183 - DNA, 23 bp, synthetic construct
  source 1..23: mol_type = other DNA
ccgagctgcagtggctcygagcg

SEQ ID NO: 4184 - DNA, 23 bp, synthetic construct
  source 1..23: mol_type = other DNA
ccacctccgggaacagcagygag

SEQ ID NO: 4185 - DNA, 23 bp, synthetic construct
  source 1..23: mol_type = other DNA
cctccgggaacagcagygagagc

SEQ ID NO: 4186 - DNA, 23 bp, synthetic construct
  source 1..23: mol_type = other DNA
cgggacccrcttccacagacagg

SEQ ID NO: 4187 - DNA, 23 bp, synthetic construct
  source 1..23: mol_type = other DNA
ccaggagtgggaagcggyggggc

SEQ ID NO: 4188 - DNA, 23 bp, synthetic construct
  source 1..23: mol_type = other DNA
cttcrcttgcatcagagctcggg

SEQ ID NO: 4189 - DNA, 23 bp, synthetic construct
  source 1..23: mol_type = other DNA
tcttcrcttgcatcagagctcgg

SEQ ID NO: 4190 - DNA, 23 bp, synthetic construct
  source 1..23: mol_type = other DNA
ccaccaccacctcggycacaggt

SEQ ID NO: 4191 - DNA, 23 bp, synthetic construct
  source 1..23: mol_type = other DNA
ccgtcagtgagatggyctccaac

SEQ ID NO: 4192 - DNA, 23 bp, synthetic construct
  source 1..23: mol_type = other DNA
cgagrtaggatgagggccaaggg

SEQ ID NO: 4193 - DNA, 23 bp, synthetic construct
  source 1..23: mol_type = other DNA
acgagrtaggatgagggccaagg

SEQ ID NO: 4194 - DNA, 23 bp, synthetic construct
  source 1..23: mol_type = other DNA
ctgrcggcacggcttcaacgtgg

SEQ ID NO: 4195 - DNA, 23 bp, synthetic construct
  source 1..23: mol_type = other DNA
ccggagaatcacctacyacaact

SEQ ID NO: 4196 - DNA, 23 bp, synthetic construct
  source 1..23: mol_type = other DNA
ccccacccaggtgcagctgygac

SEQ ID NO: 4197 - DNA, 23 bp, synthetic construct
  source 1..23: mol_type = other DNA
cccacccaggtgcagctgygacc

SEQ ID NO: 4198 - DNA, 23 bp, synthetic construct
  source 1..23: mol_type = other DNA
ccacccaggtgcagctgygacct

SEQ ID NO: 4199 - DNA, 23 bp, synthetic construct
  source 1..23: mol_type = other DNA
cccaggtgcagctgygacctgtc

SEQ ID NO: 4200 - DNA, 23 bp, synthetic construct
  source 1..23: mol_type = other DNA
ccccatttacatcatcayagagt

SEQ ID NO: 4201 - DNA, 23 bp, synthetic construct
  source 1..23: mol_type = other DNA
cccatttacatcatcayagagta

SEQ ID NO: 4202 - DNA, 23 bp, synthetic construct
  source 1..23: mol_type = other DNA
ccatttacatcatcayagagtat

SEQ ID NO: 4203 - DNA, 23 bp, synthetic construct
  source 1..23: mol_type = other DNA
ccacccagccatccttyggtccc

SEQ ID NO: 4204 - DNA, 23 bp, synthetic construct
  source 1..23: mol_type = other DNA
aagttcrtggtgccaatcagtgg

SEQ ID NO: 4205 - DNA, 23 bp, synthetic construct
  source 1..23: mol_type = other DNA
ccctccccatagttacygtacac

SEQ ID NO: 4206 - DNA, 23 bp, synthetic construct
  source 1..23: mol_type = other DNA
cctccccatagttacygtacacg

SEQ ID NO: 4207 - DNA, 23 bp, synthetic construct
  source 1..23: mol_type = other DNA
ctgaagccragtgtttaagacgg

SEQ ID NO: 4208 - DNA, 23 bp, synthetic construct
  source 1..23: mol_type = other DNA
ttggcrgggtgagtgcccacggg

SEQ ID NO: 4209 - DNA, 23 bp, synthetic construct
  source 1..23: mol_type = other DNA
tttggcrgggtgagtgcccacgg

SEQ ID NO: 4210 - DNA, 23 bp, synthetic construct
  source 1..23: mol_type = other DNA
ttgrtgggttacatgaagttagg

SEQ ID NO: 4211 - DNA, 23 bp, synthetic construct
  source 1..23: mol_type = other DNA
tacrtaagtagcaggcgctgagg

SEQ ID NO: 4212 - DNA, 23 bp, synthetic construct
  source 1..23: mol_type = other DNA
cctctcctctagggccgccyagt

SEQ ID NO: 4213 - DNA, 23 bp, synthetic construct
  source 1..23: mol_type = other DNA
cctctagggccgccyagtatgct

SEQ ID NO: 4214 - DNA, 23 bp, synthetic construct
  source 1..23: mol_type = other DNA
ccgggtgaatgatactgttyttg

SEQ ID NO: 4215 - DNA, 23 bp, synthetic construct
  source 1..23: mol_type = other DNA
tcatgrtgtattcctcttactgg

SEQ ID NO: 4216 - DNA, 23 bp, synthetic construct
  source 1..23: mol_type = other DNA
tgttgtgrggatccaggccctgg

SEQ ID NO: 4217 - DNA, 23 bp, synthetic construct
  source 1..23: mol_type = other DNA
ccctggcagaaatggatyggtgg

SEQ ID NO: 4218 - DNA, 23 bp, synthetic construct
  source 1..23: mol_type = other DNA
cctggcagaaatggatyggtggc

SEQ ID NO: 4219 - DNA, 23 bp, synthetic construct
  source 1..23: mol_type = other DNA
cctgtgaaaccctaygagactgg

SEQ ID NO: 4220 - DNA, 23 bp, synthetic construct
  source 1..23: mol_type = other DNA
ccccaagccgggggygaagtgga

SEQ ID NO: 4221 - DNA, 23 bp, synthetic construct
  source 1..23: mol_type = other DNA
cctccgactcggaayggcttccg

SEQ ID NO: 4222 - DNA, 23 bp, synthetic construct
  source 1..23: mol_type = other DNA
ccactacctcagctgcayctccc

SEQ ID NO: 4223 - DNA, 23 bp, synthetic construct
  source 1..23: mol_type = other DNA
ccctccaactcaccttgycatgg

SEQ ID NO: 4224 - DNA, 23 bp, synthetic construct
  source 1..23: mol_type = other DNA
cctccaactcaccttgycatgga

SEQ ID NO: 4225 - DNA, 23 bp, synthetic construct
  source 1..23: mol_type = other DNA
ggtagraaacaaatgccaagtgg

SEQ ID NO: 4226 - DNA, 23 bp, synthetic construct
  source 1..23: mol_type = other DNA
taagtrcatggtaagtataccgg

SEQ ID NO: 4227 - DNA, 23 bp, synthetic construct
  source 1..23: mol_type = other DNA
ctacccrgatgcagtcctttggg

SEQ ID NO: 4228 - DNA, 23 bp, synthetic construct
  source 1..23: mol_type = other DNA
gctacccrgatgcagtcctttgg

SEQ ID NO: 4229 - DNA, 23 bp, synthetic construct
  source 1..23: mol_type = other DNA
ttcatgrgaacagagctgaatgg

SEQ ID NO: 4230 - DNA, 23 bp, synthetic construct
  source 1..23: mol_type = other DNA
gcagragccgccacgggaccggg

SEQ ID NO: 4231 - DNA, 23 bp, synthetic construct
  source 1..23: mol_type = other DNA
ggcagragccgccacgggaccgg

SEQ ID NO: 4232 - DNA, 23 bp, synthetic construct
  source 1..23: mol_type = other DNA
cattgtcrgcctcctgaaagagg

SEQ ID NO: 4233 - DNA, 23 bp, synthetic construct
  source 1..23: mol_type = other DNA
ccgccgttgtgttcatygagcta

SEQ ID NO: 4234 - DNA, 23 bp, synthetic construct
  source 1..23: mol_type = other DNA
cccgcgccctactcggyaggtga

SEQ ID NO: 4235 - DNA, 23 bp, synthetic construct
  source 1..23: mol_type = other DNA
ccgcgccctactcggyaggtgag

SEQ ID NO: 4236 - DNA, 23 bp, synthetic construct
  source 1..23: mol_type = other DNA
gaggrcgcggtcaaccaccatgg

SEQ ID NO: 4237 - DNA, 23 bp, synthetic construct
  source 1..23: mol_type = other DNA
cccactgaagaattcayggacaa

SEQ ID NO: 4238 - DNA, 23 bp, synthetic construct
  source 1..23: mol_type = other DNA
ccactgaagaattcayggacaaa

SEQ ID NO: 4239 - DNA, 23 bp, synthetic construct
  source 1..23: mol_type = other DNA
ccctgatctctctcctacaycca

SEQ ID NO: 4240 - DNA, 23 bp, synthetic construct
  source 1..23: mol_type = other DNA
cctgatctctctcctacayccac

SEQ ID NO: 4241 - DNA, 23 bp, synthetic construct
  source 1..23: mol_type = other DNA
ccatccagtttgagygggcgctg

SEQ ID NO: 4242 - DNA, 23 bp, synthetic construct
  source 1..23: mol_type = other DNA
ccttrttccaatcccaggtaagg

SEQ ID NO: 4243 - DNA, 23 bp, synthetic construct
  source 1..23: mol_type = other DNA
tctctctraaatcactgagcagg

SEQ ID NO: 4244 - DNA, 23 bp, synthetic construct
  source 1..23: mol_type = other DNA
gtatragcacgagaaggacctgg

SEQ ID NO: 4245 - DNA, 23 bp, synthetic construct
  source 1..23: mol_type = other DNA
ccctgtggatgaccaayaagatg

SEQ ID NO: 4246 - DNA, 23 bp, synthetic construct
  source 1..23: mol_type = other DNA
cctgtggatgaccaayaagatgc

SEQ ID NO: 4247 - DNA, 23 bp, synthetic construct
  source 1..23: mol_type = other DNA
cctcaccragccgcgcgtgcggg

SEQ ID NO: 4248 - DNA, 23 bp, synthetic construct
  source 1..23: mol_type = other DNA
acctcaccragccgcgcgtgcgg

SEQ ID NO: 4249 - DNA, 23 bp, synthetic construct
  source 1..23: mol_type = other DNA
cacrcgaagaaatcgctgtgtgg

SEQ ID NO: 4250 - DNA, 23 bp, synthetic construct
  source 1..23: mol_type = other DNA
ccttacggaagcccgagtcyggg

SEQ ID NO: 4251 - DNA, 23 bp, synthetic construct
  source 1..23: mol_type = other DNA
cctctgratgggcctcagcaagg

SEQ ID NO: 4252 - DNA, 23 bp, synthetic construct
  source 1..23: mol_type = other DNA
cctgctcacccagtttgacygac

SEQ ID NO: 4253 - DNA, 23 bp, synthetic construct
  source 1..23: mol_type = other DNA
ccggctgcgcttcctgyagctgc

SEQ ID NO: 4254 - DNA, 23 bp, synthetic construct
  source 1..23: mol_type = other DNA
cctttaaagctgatcygatatgt

SEQ ID NO: 4255 - DNA, 23 bp, synthetic construct
  source 1..23: mol_type = other DNA
acagtttgrgaaagtgcaggtgg

SEQ ID NO: 4256 - DNA, 23 bp, synthetic construct
  source 1..23: mol_type = other DNA
cacaracagaactgtccttgtgg

SEQ ID NO: 4257 - DNA, 23 bp, synthetic construct
  source 1..23: mol_type = other DNA
ttctgrtaaaggggtgattgggg

SEQ ID NO: 4258 - DNA, 23 bp, synthetic construct
  source 1..23: mol_type = other DNA
tttctgrtaaaggggtgattggg

SEQ ID NO: 4259 - DNA, 23 bp, synthetic construct
  source 1..23: mol_type = other DNA
atttctgrtaaaggggtgattgg

SEQ ID NO: 4260 - DNA, 23 bp, synthetic construct
  source 1..23: mol_type = other DNA
acagcartgacggagaacttcgg

SEQ ID NO: 4261 - DNA, 23 bp, synthetic construct
  source 1..23: mol_type = other DNA
ccagaattgatctctatttytca

SEQ ID NO: 4262 - DNA, 23 bp, synthetic construct
  source 1..23: mol_type = other DNA
ccagagaaaccagttcyggtaat

SEQ ID NO: 4263 - DNA, 23 bp, synthetic construct
  source 1..23: mol_type = other DNA
ccaaatccaggaccaygagatag

SEQ ID NO: 4264 - DNA, 23 bp, synthetic construct
  source 1..23: mol_type = other DNA
cctggtgacgacacagagaygac

SEQ ID NO: 4265 - DNA, 23 bp, synthetic construct
  source 1..23: mol_type = other DNA
ccttcaccagctcttayagaata

SEQ ID NO: 4266 - DNA, 23 bp, synthetic construct
  source 1..23: mol_type = other DNA
ccttgcagggggaaygtggatca

SEQ ID NO: 4267 - DNA, 23 bp, synthetic construct
  source 1..23: mol_type = other DNA
cctggatcatatcatytactctg

SEQ ID NO: 4268 - DNA, 23 bp, synthetic construct
  source 1..23: mol_type = other DNA
cctcctaagatgtgggagtygag

SEQ ID NO: 4269 - DNA, 23 bp, synthetic construct
  source 1..23: mol_type = other DNA
cctaagatgtgggagtygagtgg

SEQ ID NO: 4270 - DNA, 23 bp, synthetic construct
  source 1..23: mol_type = other DNA
tggccrgtgagggggatattggg

SEQ ID NO: 4271 - DNA, 23 bp, synthetic construct
  source 1..23: mol_type = other DNA
ctggccrgtgagggggatattgg

SEQ ID NO: 4272 - DNA, 23 bp, synthetic construct
  source 1..23: mol_type = other DNA
tcggtaccragacagaagctggg

SEQ ID NO: 4273 - DNA, 23 bp, synthetic construct
  source 1..23: mol_type = other DNA
ccaagggaccggagatcygcact

SEQ ID NO: 4274 - DNA, 23 bp, synthetic construct
  source 1..23: mol_type = other DNA
ccaagccccggccaaygagggca

SEQ ID NO: 4275 - DNA, 23 bp, synthetic construct
  source 1..23: mol_type = other DNA
ccccaaccagaacgtcyagcagg

SEQ ID NO: 4276 - DNA, 23 bp, synthetic construct
  source 1..23: mol_type = other DNA
cccaaccagaacgtcyagcaggc

SEQ ID NO: 4277 - DNA, 23 bp, synthetic construct
  source 1..23: mol_type = other DNA
ccaaccagaacgtcyagcaggcc

SEQ ID NO: 4278 - DNA, 23 bp, synthetic construct
  source 1..23: mol_type = other DNA
tcttccragcttcagatttctgg

SEQ ID NO: 4279 - DNA, 23 bp, synthetic construct
  source 1..23: mol_type = other DNA
ccagtacagccagagaagcyagg

SEQ ID NO: 4280 - DNA, 23 bp, synthetic construct
  source 1..23: mol_type = other DNA
ggcrggctgtggaccgggcacgg

SEQ ID NO: 4281 - DNA, 23 bp, synthetic construct
  source 1..23: mol_type = other DNA
agacgggcrggctgtggaccggg

SEQ ID NO: 4282 - DNA, 23 bp, synthetic construct
  source 1..23: mol_type = other DNA
catgccgcrcatgtaggccatgg

SEQ ID NO: 4283 - DNA, 23 bp, synthetic construct
  source 1..23: mol_type = other DNA
cctagaccagctggtgtggyggg

SEQ ID NO: 4284 - DNA, 23 bp, synthetic construct
  source 1..23: mol_type = other DNA
ccagggtgatgctgayagggaca

SEQ ID NO: 4285 - DNA, 23 bp, synthetic construct
  source 1..23: mol_type = other DNA
cctggtggagctggtgyagtact

SEQ ID NO: 4286 - DNA, 23 bp, synthetic construct
  source 1..23: mol_type = other DNA
cttractgctgggatggaaaagg

SEQ ID NO: 4287 - DNA, 23 bp, synthetic construct
  source 1..23: mol_type = other DNA
ccccatgctgttgaacygaccac

SEQ ID NO: 4288 - DNA, 23 bp, synthetic construct
  source 1..23: mol_type = other DNA
cccatgctgttgaacygaccact

SEQ ID NO: 4289 - DNA, 23 bp, synthetic construct
  source 1..23: mol_type = other DNA
ccatgctgttgaacygaccactg

SEQ ID NO: 4290 - DNA, 23 bp, synthetic construct
  source 1..23: mol_type = other DNA
cctgccaatcatcatatygattg

SEQ ID NO: 4291 - DNA, 23 bp, synthetic construct
  source 1..23: mol_type = other DNA
cctgcccgcaggagctgyagctg

SEQ ID NO: 4292 - DNA, 23 bp, synthetic construct
  source 1..23: mol_type = other DNA
cctgcgggagcgagcggagyagg

SEQ ID NO: 4293 - DNA, 23 bp, synthetic construct
  source 1..23: mol_type = other DNA
cccaagaggctgcgygactgcgg

SEQ ID NO: 4294 - DNA, 23 bp, synthetic construct
  source 1..23: mol_type = other DNA
caartgagatttagctggagagg

SEQ ID NO: 4295 - DNA, 23 bp, synthetic construct
  source 1..23: mol_type = other DNA
acccacaartgagatttagctgg

SEQ ID NO: 4296 - DNA, 23 bp, synthetic construct
  source 1..23: mol_type = other DNA
gttgactrctgcccactgcttgg

SEQ ID NO: 4297 - DNA, 23 bp, synthetic construct
  source 1..23: mol_type = other DNA
ttactgtcrtaaccccgataggg

SEQ ID NO: 4298 - DNA, 23 bp, synthetic construct
  source 1..23: mol_type = other DNA
cccccagaaacacatgygacttt

SEQ ID NO: 4299 - DNA, 23 bp, synthetic construct
  source 1..23: mol_type = other DNA
ccccagaaacacatgygactttt

SEQ ID NO: 4300 - DNA, 23 bp, synthetic construct
  source 1..23: mol_type = other DNA
cccagaaacacatgygacttttc

SEQ ID NO: 4301 - DNA, 23 bp, synthetic construct
  source 1..23: mol_type = other DNA
cccatggaatgctttcyctggca

SEQ ID NO: 4302 - DNA, 23 bp, synthetic construct
  source 1..23: mol_type = other DNA
ccatggaatgctttcyctggcaa

SEQ ID NO: 4303 - DNA, 23 bp, synthetic construct
  source 1..23: mol_type = other DNA
ccttccacctgtttattgytgca

SEQ ID NO: 4304 - DNA, 23 bp, synthetic construct
  source 1..23: mol_type = other DNA
ccacctgtttattgytgcatttg

SEQ ID NO: 4305 - DNA, 23 bp, synthetic construct
  source 1..23: mol_type = other DNA
cctggtgtttgcctgctytgctg

SEQ ID NO: 4306 - DNA, 23 bp, synthetic construct
  source 1..23: mol_type = other DNA
ctactccrtgacagcgcctgagg

SEQ ID NO: 4307 - DNA, 23 bp, synthetic construct
  source 1..23: mol_type = other DNA
ccaccatgatcctgtygatcatc

SEQ ID NO: 4308 - DNA, 23 bp, synthetic construct
  source 1..23: mol_type = other DNA
ccatttccagactgygagaggcc

SEQ ID NO: 4309 - DNA, 23 bp, synthetic construct
  source 1..23: mol_type = other DNA
ctgagragttctttctcaagtgg

SEQ ID NO: 4310 - DNA, 23 bp, synthetic construct
  source 1..23: mol_type = other DNA
tgtatraagggtacccactctgg

SEQ ID NO: 4311 - DNA, 23 bp, synthetic construct
  source 1..23: mol_type = other DNA
ccaagcggaggattactcgyagc

SEQ ID NO: 4312 - DNA, 23 bp, synthetic construct
  source 1..23: mol_type = other DNA
tgtccrgctggtggctgctgtgg

SEQ ID NO: 4313 - DNA, 23 bp, synthetic construct
  source 1..23: mol_type = other DNA
gtcagrgtggctggcccagcagg

SEQ ID NO: 4314 - DNA, 23 bp, synthetic construct
  source 1..23: mol_type = other DNA
tgcragtccacaaagatggtggg

SEQ ID NO: 4315 - DNA, 23 bp, synthetic construct
  source 1..23: mol_type = other DNA
atgcragtccacaaagatggtgg

SEQ ID NO: 4316 - DNA, 23 bp, synthetic construct
  source 1..23: mol_type = other DNA
gccatgcragtccacaaagatgg

SEQ ID NO: 4317 - DNA, 23 bp, synthetic construct
  source 1..23: mol_type = other DNA
cctcacgtacccagtcayctcca

SEQ ID NO: 4318 - DNA, 23 bp, synthetic construct
  source 1..23: mol_type = other DNA
ccccacagcggacatcgccygca

SEQ ID NO: 4319 - DNA, 23 bp, synthetic construct
  source 1..23: mol_type = other DNA
cccacagcggacatcgccygcag

SEQ ID NO: 4320 - DNA, 23 bp, synthetic construct
  source 1..23: mol_type = other DNA
ccacagcggacatcgccygcagc

SEQ ID NO: 4321 - DNA, 23 bp, synthetic construct
  source 1..23: mol_type = other DNA
gaccrgatagtctttcggcgggg

SEQ ID NO: 4322 - DNA, 23 bp, synthetic construct
  source 1..23: mol_type = other DNA
tgaccrgatagtctttcggcggg

SEQ ID NO: 4323 - DNA, 23 bp, synthetic construct
  source 1..23: mol_type = other DNA
atgaccrgatagtctttcggcgg

SEQ ID NO: 4324 - DNA, 23 bp, synthetic construct
  source 1..23: mol_type = other DNA
ccaaccgcctgcatgacyggata

SEQ ID NO: 4325 - DNA, 23 bp, synthetic construct
  source 1..23: mol_type = other DNA
cctgcttgcttccggctccygag

SEQ ID NO: 4326 - DNA, 23 bp, synthetic construct
  source 1..23: mol_type = other DNA
ggtrggctagctcgccgcttcgg

SEQ ID NO: 4327 - DNA, 23 bp, synthetic construct
  source 1..23: mol_type = other DNA
gttctcacraatgtccttcatgg

SEQ ID NO: 4328 - DNA, 23 bp, synthetic construct
  source 1..23: mol_type = other DNA
gaagctrcttagccctgagatgg

SEQ ID NO: 4329 - DNA, 23 bp, synthetic construct
  source 1..23: mol_type = other DNA
gccrggctgtggagcccacatgg

SEQ ID NO: 4330 - DNA, 23 bp, synthetic construct
  source 1..23: mol_type = other DNA
ccarcaagttgcccatcgagggg

SEQ ID NO: 4331 - DNA, 23 bp, synthetic construct
  source 1..23: mol_type = other DNA
gccarcaagttgcccatcgaggg

SEQ ID NO: 4332 - DNA, 23 bp, synthetic construct
  source 1..23: mol_type = other DNA
agccarcaagttgcccatcgagg

SEQ ID NO: 4333 - DNA, 23 bp, synthetic construct
  source 1..23: mol_type = other DNA
agcccggcragtgatggtgccgg

SEQ ID NO: 4334 - DNA, 23 bp, synthetic construct
  source 1..23: mol_type = other DNA
tgccrgcaccatcactcgccggg

SEQ ID NO: 4335 - DNA, 23 bp, synthetic construct
  source 1..23: mol_type = other DNA
ctgccrgcaccatcactcgccgg

SEQ ID NO: 4336 - DNA, 23 bp, synthetic construct
  source 1..23: mol_type = other DNA
ccaggtagcgaacctygtcatgg

SEQ ID NO: 4337 - DNA, 23 bp, synthetic construct
  source 1..23: mol_type = other DNA
ccggcaccatcactcgcygggct

SEQ ID NO: 4338 - DNA, 23 bp, synthetic construct
  source 1..23: mol_type = other DNA
cctggtgcagccagyggctggtg

SEQ ID NO: 4339 - DNA, 23 bp, synthetic construct
  source 1..23: mol_type = other DNA
ccccctggaggtccctaytggtg

SEQ ID NO: 4340 - DNA, 23 bp, synthetic construct
  source 1..23: mol_type = other DNA
cccctggaggtccctaytggtgc

SEQ ID NO: 4341 - DNA, 23 bp, synthetic construct
  source 1..23: mol_type = other DNA
ccctggaggtccctaytggtgcc

SEQ ID NO: 4342 - DNA, 23 bp, synthetic construct
  source 1..23: mol_type = other DNA
cctggaggtccctaytggtgcca

SEQ ID NO: 4343 - DNA, 23 bp, synthetic construct
  source 1..23: mol_type = other DNA
ccctgcatggacccygggcccca

SEQ ID NO: 4344 - DNA, 23 bp, synthetic construct
  source 1..23: mol_type = other DNA
ccagagttgccaaccccyggctg

SEQ ID NO: 4345 - DNA, 23 bp, synthetic construct
  source 1..23: mol_type = other DNA
cctttgctctaggtccataytac

SEQ ID NO: 4346 - DNA, 23 bp, synthetic construct
  source 1..23: mol_type = other DNA
tctcgcccraccccaacctccgg

SEQ ID NO: 4347 - DNA, 23 bp, synthetic construct
  source 1..23: mol_type = other DNA
gaactcrggtggggagaaggagg

SEQ ID NO: 4348 - DNA, 23 bp, synthetic construct
  source 1..23: mol_type = other DNA
tctttgacrctgcctacttcggg

SEQ ID NO: 4349 - DNA, 23 bp, synthetic construct
  source 1..23: mol_type = other DNA
cctgacctaccttcagaagygag

SEQ ID NO: 4350 - DNA, 23 bp, synthetic construct
  source 1..23: mol_type = other DNA
cctaccttcagaagygaggactg

SEQ ID NO: 4351 - DNA, 23 bp, synthetic construct
  source 1..23: mol_type = other DNA
ccccgagtggctcttcygaatct

SEQ ID NO: 4352 - DNA, 23 bp, synthetic construct
  source 1..23: mol_type = other DNA
cccgagtggctcttcygaatcta

SEQ ID NO: 4353 - DNA, 23 bp, synthetic construct
  source 1..23: mol_type = other DNA
ccgagtggctcttcygaatctac

SEQ ID NO: 4354 - DNA, 23 bp, synthetic construct
  source 1..23: mol_type = other DNA
cttgrgaggtaggagtcatcagg

SEQ ID NO: 4355 - DNA, 23 bp, synthetic construct
  source 1..23: mol_type = other DNA
ccacccgctccctgaacaygtga

SEQ ID NO: 4356 - DNA, 23 bp, synthetic construct
  source 1..23: mol_type = other DNA
cccgctccctgaacaygtgagtg

SEQ ID NO: 4357 - DNA, 23 bp, synthetic construct
  source 1..23: mol_type = other DNA
ccgctccctgaacaygtgagtgt

SEQ ID NO: 4358 - DNA, 23 bp, synthetic construct
  source 1..23: mol_type = other DNA
ttacgrgatggttggtcccctgg

SEQ ID NO: 4359 - DNA, 23 bp, synthetic construct
  source 1..23: mol_type = other DNA
cccaggtcctgctgygaggaggc

SEQ ID NO: 4360 - DNA, 23 bp, synthetic construct
  source 1..23: mol_type = other DNA
cccagagacactcaygttcaggg

SEQ ID NO: 4361 - DNA, 23 bp, synthetic construct
  source 1..23: mol_type = other DNA
ccagrtgagcaagtgcccgcagg

SEQ ID NO: 4362 - DNA, 23 bp, synthetic construct
  source 1..23: mol_type = other DNA
cggctrccgccgctcggatgagg

SEQ ID NO: 4363 - DNA, 23 bp, synthetic construct
  source 1..23: mol_type = other DNA
ccggaggcagagagaaaaayggg

SEQ ID NO: 4364 - DNA, 23 bp, synthetic construct
  source 1..23: mol_type = other DNA
cctctgcaactctgcytctgata

SEQ ID NO: 4365 - DNA, 23 bp, synthetic construct
  source 1..23: mol_type = other DNA
cctgcacccggtgctcygagagc

SEQ ID NO: 4366 - DNA, 23 bp, synthetic construct
  source 1..23: mol_type = other DNA
ccggagaagcgttcaytcgaggc

SEQ ID NO: 4367 - DNA, 23 bp, synthetic construct
  source 1..23: mol_type = other DNA
tcgctccrtggaggctgtgcagg

SEQ ID NO: 4368 - DNA, 23 bp, synthetic construct
  source 1..23: mol_type = other DNA
ccatggacagtctctgcygtgga

SEQ ID NO: 4369 - DNA, 23 bp, synthetic construct
  source 1..23: mol_type = other DNA
cctgaagaaaatgctgattygac

SEQ ID NO: 4370 - DNA, 23 bp, synthetic construct
  source 1..23: mol_type = other DNA
ctcgctgragggactgcagccgg

SEQ ID NO: 4371 - DNA, 23 bp, synthetic construct
  source 1..23: mol_type = other DNA
ccttcccagtggacacayaaagg

SEQ ID NO: 4372 - DNA, 23 bp, synthetic construct
  source 1..23: mol_type = other DNA
cccaggaggagcagaygggctgc

SEQ ID NO: 4373 - DNA, 23 bp, synthetic construct
  source 1..23: mol_type = other DNA
ccaggaggagcagaygggctgcc

SEQ ID NO: 4374 - DNA, 23 bp, synthetic construct
  source 1..23: mol_type = other DNA
cagcrgaagaaagaagcactggg

SEQ ID NO: 4375 - DNA, 23 bp, synthetic construct
  source 1..23: mol_type = other DNA
tcagcrgaagaaagaagcactgg

SEQ ID NO: 4376 - DNA, 23 bp, synthetic construct
  source 1..23: mol_type = other DNA
cagrtgagtggggtcggccgggg

SEQ ID NO: 4377 - DNA, 23 bp, synthetic construct
  source 1..23: mol_type = other DNA
ccagrtgagtggggtcggccggg

SEQ ID NO: 4378 - DNA, 23 bp, synthetic construct
  source 1..23: mol_type = other DNA
cccagrtgagtggggtcggccgg

SEQ ID NO: 4379 - DNA, 23 bp, synthetic construct
  source 1..23: mol_type = other DNA
ccagaagcataacattyaagcgc

SEQ ID NO: 4380 - DNA, 23 bp, synthetic construct
  source 1..23: mol_type = other DNA
cacrtacgtaagggccatggtgg

SEQ ID NO: 4381 - DNA, 23 bp, synthetic construct
  source 1..23: mol_type = other DNA
tgccacrtacgtaagggccatgg

SEQ ID NO: 4382 - DNA, 23 bp, synthetic construct
  source 1..23: mol_type = other DNA
actgtgrctccctcctctacggg

SEQ ID NO: 4383 - DNA, 23 bp, synthetic construct
  source 1..23: mol_type = other DNA
cactgtgrctccctcctctacgg

SEQ ID NO: 4384 - DNA, 23 bp, synthetic construct
  source 1..23: mol_type = other DNA
ctctacrggcttgtgcaccaggg

SEQ ID NO: 4385 - DNA, 23 bp, synthetic construct
  source 1..23: mol_type = other DNA
cctctacrggcttgtgcaccagg

SEQ ID NO: 4386 - DNA, 23 bp, synthetic construct
  source 1..23: mol_type = other DNA
ctctacgrgcttgtgcaccaggg

SEQ ID NO: 4387 - DNA, 23 bp, synthetic construct
  source 1..23: mol_type = other DNA
cctctacgrgcttgtgcaccagg

SEQ ID NO: 4388 - DNA, 23 bp, synthetic construct
  source 1..23: mol_type = other DNA
aatrctcctgtgagtgacctggg

SEQ ID NO: 4389 - DNA, 23 bp, synthetic construct
  source 1..23: mol_type = other DNA
aaatrctcctgtgagtgacctgg

SEQ ID NO: 4390 - DNA, 23 bp, synthetic construct
  source 1..23: mol_type = other DNA
aaargcagttttgggaaggttgg

SEQ ID NO: 4391 - DNA, 23 bp, synthetic construct
  source 1..23: mol_type = other DNA
aggaaaargcagttttgggaagg

SEQ ID NO: 4392 - DNA, 23 bp, synthetic construct
  source 1..23: mol_type = other DNA
ccaggacccccggaacaaayaca

SEQ ID NO: 4393 - DNA, 23 bp, synthetic construct
  source 1..23: mol_type = other DNA
gggcracagtggggggcccatgg

SEQ ID NO: 4394 - DNA, 23 bp, synthetic construct
  source 1..23: mol_type = other DNA
aaaatrtggatgacacagtaagg

SEQ ID NO: 4395 - DNA, 23 bp, synthetic construct
  source 1..23: mol_type = other DNA
ccaccgacaatgacatcgyactg

SEQ ID NO: 4396 - DNA, 23 bp, synthetic construct
  source 1..23: mol_type = other DNA
ccgacaatgacatcgyactgctg

SEQ ID NO: 4397 - DNA, 23 bp, synthetic construct
  source 1..23: mol_type = other DNA
cccagcccgccaccctctygcag

SEQ ID NO: 4398 - DNA, 23 bp, synthetic construct
  source 1..23: mol_type = other DNA
ccagcccgccaccctctygcaga

SEQ ID NO: 4399 - DNA, 23 bp, synthetic construct
  source 1..23: mol_type = other DNA
ccgtcacagcagcctggagyggg

SEQ ID NO: 4400 - DNA, 23 bp, synthetic construct
  source 1..23: mol_type = other DNA
cacrggctcgctcctgggccagg

SEQ ID NO: 4401 - DNA, 23 bp, synthetic construct
  source 1..23: mol_type = other DNA
tgccgcacrggctcgctcctggg

SEQ ID NO: 4402 - DNA, 23 bp, synthetic construct
  source 1..23: mol_type = other DNA
ccttgaaccagagctccygggag

SEQ ID NO: 4403 - DNA, 23 bp, synthetic construct
  source 1..23: mol_type = other DNA
cctgacagagtacaaygccaaac

SEQ ID NO: 4404 - DNA, 23 bp, synthetic construct
  source 1..23: mol_type = other DNA
ggcccragagagtcttgcccggg

SEQ ID NO: 4405 - DNA, 23 bp, synthetic construct
  source 1..23: mol_type = other DNA
gggcccragagagtcttgcccgg

SEQ ID NO: 4406 - DNA, 23 bp, synthetic construct
  source 1..23: mol_type = other DNA
cccggcgccgccacygcaccacc

SEQ ID NO: 4407 - DNA, 23 bp, synthetic construct
  source 1..23: mol_type = other DNA
ccccgacatctgggccygagaga

SEQ ID NO: 4408 - DNA, 23 bp, synthetic construct
  source 1..23: mol_type = other DNA
cccgacatctgggccygagagag

SEQ ID NO: 4409 - DNA, 23 bp, synthetic construct
  source 1..23: mol_type = other DNA
ccgacatctgggccygagagagt

SEQ ID NO: 4410 - DNA, 23 bp, synthetic construct
  source 1..23: mol_type = other DNA
ccgcagrtgaggggccctggggg

SEQ ID NO: 4411 - DNA, 23 bp, synthetic construct
  source 1..23: mol_type = other DNA
gccgcagrtgaggggccctgggg

SEQ ID NO: 4412 - DNA, 23 bp, synthetic construct
  source 1..23: mol_type = other DNA
ggccgcagrtgaggggccctggg

SEQ ID NO: 4413 - DNA, 23 bp, synthetic construct
  source 1..23: mol_type = other DNA
cctttccagtgatgaacyagtgg

SEQ ID NO: 4414 - DNA, 23 bp, synthetic construct
  source 1..23: mol_type = other DNA
ctgcgrcaacaacggttttcggg

SEQ ID NO: 4415 - DNA, 23 bp, synthetic construct
  source 1..23: mol_type = other DNA
gctgcgrcaacaacggttttcgg

SEQ ID NO: 4416 - DNA, 23 bp, synthetic construct
  source 1..23: mol_type = other DNA
ggagacctrgaaggcctttctgg

SEQ ID NO: 4417 - DNA, 23 bp, synthetic construct
  source 1..23: mol_type = other DNA
gaacgrcatgaagtactaccggg

SEQ ID NO: 4418 - DNA, 23 bp, synthetic construct
  source 1..23: mol_type = other DNA
agaacgrcatgaagtactaccgg

SEQ ID NO: 4419 - DNA, 23 bp, synthetic construct
  source 1..23: mol_type = other DNA
ctgcrgcaacaacggttttcggg

SEQ ID NO: 4420 - DNA, 23 bp, synthetic construct
  source 1..23: mol_type = other DNA
gctgcrgcaacaacggttttcgg

SEQ ID NO: 4421 - DNA, 23 bp, synthetic construct
  source 1..23: mol_type = other DNA
cctgaagattgaactcygaaaga

SEQ ID NO: 4422 - DNA, 23 bp, synthetic construct
  source 1..23: mol_type = other DNA
cctttcagctgctgcaatcytag

SEQ ID NO: 4423 - DNA, 23 bp, synthetic construct
  source 1..23: mol_type = other DNA
taarcatcgtggcgctggtgggg

SEQ ID NO: 4424 - DNA, 23 bp, synthetic construct
  source 1..23: mol_type = other DNA
ttaarcatcgtggcgctggtggg

SEQ ID NO: 4425 - DNA, 23 bp, synthetic construct
  source 1..23: mol_type = other DNA
cttaarcatcgtggcgctggtgg

SEQ ID NO: 4426 - DNA, 23 bp, synthetic construct
  source 1..23: mol_type = other DNA
gctcttaarcatcgtggcgctgg

SEQ ID NO: 4427 - DNA, 23 bp, synthetic construct
  source 1..23: mol_type = other DNA
ccgccaccccagctccyagttgg

SEQ ID NO: 4428 - DNA, 23 bp, synthetic construct
  source 1..23: mol_type = other DNA
ccagagctccctaccyaggagga

SEQ ID NO: 4429 - DNA, 23 bp, synthetic construct
  source 1..23: mol_type = other DNA
gcccrgggtctacacccgcgtgg

SEQ ID NO: 4430 - DNA, 23 bp, synthetic construct
  source 1..23: mol_type = other DNA
tgtgcccratgtgcacctcccgg

SEQ ID NO: 4431 - DNA, 23 bp, synthetic construct
  source 1..23: mol_type = other DNA
ccttcctttgggctggctygagg

SEQ ID NO: 4432 - DNA, 23 bp, synthetic construct
  source 1..23: mol_type = other DNA
cctttgggctggctygagggaag

SEQ ID NO: 4433 - DNA, 23 bp, synthetic construct
  source 1..23: mol_type = other DNA
gaaargtccacttcgtatgctgg

SEQ ID NO: 4434 - DNA, 23 bp, synthetic construct
  source 1..23: mol_type = other DNA
cctggcttattatatcatytcta

SEQ ID NO: 4435 - DNA, 23 bp, synthetic construct
  source 1..23: mol_type = other DNA
ccctcaaatacggagygaagcac

SEQ ID NO: 4436 - DNA, 23 bp, synthetic construct
  source 1..23: mol_type = other DNA
cctcaaatacggagygaagcacg

SEQ ID NO: 4437 - DNA, 23 bp, synthetic construct
  source 1..23: mol_type = other DNA
cggccrtccaggggttcagaagg

SEQ ID NO: 4438 - DNA, 23 bp, synthetic construct
  source 1..23: mol_type = other DNA
caaagcgrcagccatcctggagg

SEQ ID NO: 4439 - DNA, 23 bp, synthetic construct
  source 1..23: mol_type = other DNA
gtgtgrtcacctctggcggcggg

SEQ ID NO: 4440 - DNA, 23 bp, synthetic construct
  source 1..23: mol_type = other DNA
ggtgtgrtcacctctggcggcgg

SEQ ID NO: 4441 - DNA, 23 bp, synthetic construct
  source 1..23: mol_type = other DNA
gcgagrgagatgagagacggcgg

SEQ ID NO: 4442 - DNA, 23 bp, synthetic construct
  source 1..23: mol_type = other DNA
caggcgagrgagatgagagacgg

SEQ ID NO: 4443 - DNA, 23 bp, synthetic construct
  source 1..23: mol_type = other DNA
gtttgtgrtctgccagctaaagg

SEQ ID NO: 4444 - DNA, 23 bp, synthetic construct
  source 1..23: mol_type = other DNA
tatrtgcatatttattacatcgg

SEQ ID NO: 4445 - DNA, 23 bp, synthetic construct
  source 1..23: mol_type = other DNA
aaagctrgaaagggacgaactgg

SEQ ID NO: 4446 - DNA, 23 bp, synthetic construct
  source 1..23: mol_type = other DNA
accrccaaatttaattgcagagg

SEQ ID NO: 4447 - DNA, 23 bp, synthetic construct
  source 1..23: mol_type = other DNA
ccttttgaagaccataaccyacc

SEQ ID NO: 4448 - DNA, 23 bp, synthetic construct
  source 1..23: mol_type = other DNA
ccaattcaggacccacaygacgg

SEQ ID NO: 4449 - DNA, 23 bp, synthetic construct
  source 1..23: mol_type = other DNA
cccactggcagcaggtacygagg

SEQ ID NO: 4450 - DNA, 23 bp, synthetic construct
  source 1..23: mol_type = other DNA
ccactggcagcaggtacygaggt

SEQ ID NO: 4451 - DNA, 23 bp, synthetic construct
  source 1..23: mol_type = other DNA
ccatccagatggtgyggtctcag

SEQ ID NO: 4452 - DNA, 23 bp, synthetic construct
  source 1..23: mol_type = other DNA
cccagtttctgatctcygtgttg

SEQ ID NO: 4453 - DNA, 23 bp, synthetic construct
  source 1..23: mol_type = other DNA
ccagtttctgatctcygtgttgc

SEQ ID NO: 4454 - DNA, 23 bp, synthetic construct
  source 1..23: mol_type = other DNA
agccaccrattgtacaggtaggg

SEQ ID NO: 4455 - DNA, 23 bp, synthetic construct
  source 1..23: mol_type = other DNA
gagccaccrattgtacaggtagg

SEQ ID NO: 4456 - DNA, 23 bp, synthetic construct
  source 1..23: mol_type = other DNA
ccaggcacaagtgtccygccgca

SEQ ID NO: 4457 - DNA, 23 bp, synthetic construct
  source 1..23: mol_type = other DNA
ccgtcaccatgaagyacaaggtc

SEQ ID NO: 4458 - DNA, 23 bp, synthetic construct
  source 1..23: mol_type = other DNA
cctgggctccacgcagggcyaga

SEQ ID NO: 4459 - DNA, 23 bp, synthetic construct
  source 1..23: mol_type = other DNA
ccttccagcgctgcgccyggaca

SEQ ID NO: 4460 - DNA, 23 bp, synthetic construct
  source 1..23: mol_type = other DNA
tcctrggaaactcggttaaaagg

SEQ ID NO: 4461 - DNA, 23 bp, synthetic construct
  source 1..23: mol_type = other DNA
cccagcgtgacctgggacaygga

SEQ ID NO: 4462 - DNA, 23 bp, synthetic construct
  source 1..23: mol_type = other DNA
ccagcgtgacctgggacayggag

SEQ ID NO: 4463 - DNA, 23 bp, synthetic construct
  source 1..23: mol_type = other DNA
agcrcacgaagaacatgcagcgg

SEQ ID NO: 4464 - DNA, 23 bp, synthetic construct
  source 1..23: mol_type = other DNA
ggcaccraagcctcggggacagg

SEQ ID NO: 4465 - DNA, 23 bp, synthetic construct
  source 1..23: mol_type = other DNA
ctcrtggggtggccacattgcgg

SEQ ID NO: 4466 - DNA, 23 bp, synthetic construct
  source 1..23: mol_type = other DNA
ccaatggtcagagcccygttgag

SEQ ID NO: 4467 - DNA, 23 bp, synthetic construct
  source 1..23: mol_type = other DNA
cctgtgtgtccacccayttggca

SEQ ID NO: 4468 - DNA, 23 bp, synthetic construct
  source 1..23: mol_type = other DNA
tctggrttctcgatgcgtgcagg

SEQ ID NO: 4469 - DNA, 23 bp, synthetic construct
  source 1..23: mol_type = other DNA
cccggactgcgctcccayctgaa

SEQ ID NO: 4470 - DNA, 23 bp, synthetic construct
  source 1..23: mol_type = other DNA
ccggactgcgctcccayctgaac

SEQ ID NO: 4471 - DNA, 23 bp, synthetic construct
  source 1..23: mol_type = other DNA
cgcrgtacccttagagacagagg

SEQ ID NO: 4472 - DNA, 23 bp, synthetic construct
  source 1..23: mol_type = other DNA
tgtcrtacagaaataaaatttgg

SEQ ID NO: 4473 - DNA, 23 bp, synthetic construct
  source 1..23: mol_type = other DNA
ccctgctgtgtgctycacacttc

SEQ ID NO: 4474 - DNA, 23 bp, synthetic construct
  source 1..23: mol_type = other DNA
gtggracactgctgggcaggagg

SEQ ID NO: 4475 - DNA, 23 bp, synthetic construct
  source 1..23: mol_type = other DNA
gctgtggracactgctgggcagg

SEQ ID NO: 4476 - DNA, 23 bp, synthetic construct
  source 1..23: mol_type = other DNA
attgaccrgggtggaggtgaagg

SEQ ID NO: 4477 - DNA, 23 bp, synthetic construct
  source 1..23: mol_type = other DNA
cttcrtactcggttattaaatgg

SEQ ID NO: 4478 - DNA, 23 bp, synthetic construct
  source 1..23: mol_type = other DNA
gttccrctatgattcagctttgg

SEQ ID NO: 4479 - DNA, 23 bp, synthetic construct
  source 1..23: mol_type = other DNA
ccattgcaaagaggttcygctat

SEQ ID NO: 4480 - DNA, 23 bp, synthetic construct
  source 1..23: mol_type = other DNA
cctttgcatgcccttyggaatgc

SEQ ID NO: 4481 - DNA, 23 bp, synthetic construct
  source 1..23: mol_type = other DNA
gtattactrcaatgagcatgtgg

SEQ ID NO: 4482 - DNA, 23 bp, synthetic construct
  source 1..23: mol_type = other DNA
tgagtgcarcaaggaggctccgg

SEQ ID NO: 4483 - DNA, 23 bp, synthetic construct
  source 1..23: mol_type = other DNA
cccaggtrgggattgcaccctgg

SEQ ID NO: 4484 - DNA, 23 bp, synthetic construct
  source 1..23: mol_type = other DNA
ccatgctcgagtgcygcgtgtgc

SEQ ID NO: 4485 - DNA, 23 bp, synthetic construct
  source 1..23: mol_type = other DNA
gtggcrgcggcaggagaagctgg

SEQ ID NO: 4486 - DNA, 23 bp, synthetic construct
  source 1..23: mol_type = other DNA
gagcrgctggagtcaggctcggg

SEQ ID NO: 4487 - DNA, 23 bp, synthetic construct
  source 1..23: mol_type = other DNA
ggagcrgctggagtcaggctcgg

SEQ ID NO: 4488 - DNA, 23 bp, synthetic construct
  source 1..23: mol_type = other DNA
gacaraatcttagtatcaattgg

SEQ ID NO: 4489 - DNA, 23 bp, synthetic construct
  source 1..23: mol_type = other DNA
cctcgaacacccaggygaggtca

SEQ ID NO: 4490 - DNA, 23 bp, synthetic construct
  source 1..23: mol_type = other DNA
cctgaggaggacccagagyagga

SEQ ID NO: 4491 - DNA, 23 bp, synthetic construct
  source 1..23: mol_type = other DNA
ccaatacctcacattcctygaag

SEQ ID NO: 4492 - DNA, 23 bp, synthetic construct
  source 1..23: mol_type = other DNA
ccaggaacccggacgggggyagc

SEQ ID NO: 4493 - DNA, 23 bp, synthetic construct
  source 1..23: mol_type = other DNA
ggcccagtrggccatctcacagg

SEQ ID NO: 4494 - DNA, 23 bp, synthetic construct
  source 1..23: mol_type = other DNA
aaggccgcrgtctcgtagtccgg

SEQ ID NO: 4495 - DNA, 23 bp, synthetic construct
  source 1..23: mol_type = other DNA
ggtctcrtagtccggtgagccgg

SEQ ID NO: 4496 - DNA, 23 bp, synthetic construct
  source 1..23: mol_type = other DNA
ccgcggtctcgtagtcyggtgag

SEQ ID NO: 4497 - DNA, 23 bp, synthetic construct
  source 1..23: mol_type = other DNA
ccactgacctcatgtygatgatc

SEQ ID NO: 4498 - DNA, 23 bp, synthetic construct
  source 1..23: mol_type = other DNA
ctcagrtgagcactgggatgggg

SEQ ID NO: 4499 - DNA, 23 bp, synthetic construct
  source 1..23: mol_type = other DNA
cctcagrtgagcactgggatggg

SEQ ID NO: 4500 - DNA, 23 bp, synthetic construct
  source 1..23: mol_type = other DNA
tcctcagrtgagcactgggatgg

SEQ ID NO: 4501 - DNA, 23 bp, synthetic construct
  source 1..23: mol_type = other DNA
caagrtaagtctggagaaagagg

SEQ ID NO: 4502 - DNA, 23 bp, synthetic construct
  source 1..23: mol_type = other DNA
cccttccacgacctcyagagcga

SEQ ID NO: 4503 - DNA, 23 bp, synthetic construct
  source 1..23: mol_type = other DNA
ccttccacgacctcyagagcgag

SEQ ID NO: 4504 - DNA, 23 bp, synthetic construct
  source 1..23: mol_type = other DNA
ccagagagctcgctagcygaggt

SEQ ID NO: 4505 - DNA, 23 bp, synthetic construct
  source 1..23: mol_type = other DNA
ccacttcctcctcayctacctgc

SEQ ID NO: 4506 - DNA, 23 bp, synthetic construct
  source 1..23: mol_type = other DNA
cctcagccggcgtctytgcagac

SEQ ID NO: 4507 - DNA, 23 bp, synthetic construct
  source 1..23: mol_type = other DNA
cctgcagggcgaagacctgygag

SEQ ID NO: 4508 - DNA, 23 bp, synthetic construct
  source 1..23: mol_type = other DNA
cccatgaggcccccaycttctgc

SEQ ID NO: 4509 - DNA, 23 bp, synthetic construct
  source 1..23: mol_type = other DNA
ccatgaggcccccaycttctgca

SEQ ID NO: 4510 - DNA, 23 bp, synthetic construct
  source 1..23: mol_type = other DNA
ccgggaacggcggcgggtayagc

SEQ ID NO: 4511 - DNA, 23 bp, synthetic construct
  source 1..23: mol_type = other DNA
cctgggggccaccttcatcygaa

SEQ ID NO: 4512 - DNA, 23 bp, synthetic construct
  source 1..23: mol_type = other DNA
ccgagaaagcctgaaggaaygag

SEQ ID NO: 4513 - DNA, 23 bp, synthetic construct
  source 1..23: mol_type = other DNA
cctggccagagaggccttcygca

SEQ ID NO: 4514 - DNA, 23 bp, synthetic construct
  source 1..23: mol_type = other DNA
ccagagaggccttcygcagagca

SEQ ID NO: 4515 - DNA, 23 bp, synthetic construct
  source 1..23: mol_type = other DNA
gctcraaggcttggtggccgggg

SEQ ID NO: 4516 - DNA, 23 bp, synthetic construct
  source 1..23: mol_type = other DNA
agctcraaggcttggtggccggg

SEQ ID NO: 4517 - DNA, 23 bp, synthetic construct
  source 1..23: mol_type = other DNA
aagctcraaggcttggtggccgg

SEQ ID NO: 4518 - DNA, 23 bp, synthetic construct
  source 1..23: mol_type = other DNA
acaaggcrgcttggaacaagagg

SEQ ID NO: 4519 - DNA, 23 bp, synthetic construct
  source 1..23: mol_type = other DNA
cttgctgraggagttgctgtggg

SEQ ID NO: 4520 - DNA, 23 bp, synthetic construct
  source 1..23: mol_type = other DNA
ccttgctgraggagttgctgtgg

SEQ ID NO: 4521 - DNA, 23 bp, synthetic construct
  source 1..23: mol_type = other DNA
cccttccagattgtggatcygct

SEQ ID NO: 4522 - DNA, 23 bp, synthetic construct
  source 1..23: mol_type = other DNA
ccttccagattgtggatcygctg

SEQ ID NO: 4523 - DNA, 23 bp, synthetic construct
  source 1..23: mol_type = other DNA
ccagattgtggatcygctggccc

SEQ ID NO: 4524 - DNA, 23 bp, synthetic construct
  source 1..23: mol_type = other DNA
gagrgcctgcagtgctcgtgtgg

SEQ ID NO: 4525 - DNA, 23 bp, synthetic construct
  source 1..23: mol_type = other DNA
tcgccrgctggtccaggtaatgg

SEQ ID NO: 4526 - DNA, 23 bp, synthetic construct
  source 1..23: mol_type = other DNA
cccttctccaatgcgaygggtgt

SEQ ID NO: 4527 - DNA, 23 bp, synthetic construct
  source 1..23: mol_type = other DNA
ccttctccaatgcgaygggtgtg

SEQ ID NO: 4528 - DNA, 23 bp, synthetic construct
  source 1..23: mol_type = other DNA
ccaagacggagacgagcyaggtg

SEQ ID NO: 4529 - DNA, 23 bp, synthetic construct
  source 1..23: mol_type = other DNA
cctgatctgctgggtgcyctacg

SEQ ID NO: 4530 - DNA, 23 bp, synthetic construct
  source 1..23: mol_type = other DNA
cctgcgccgcacccycactcgcc

SEQ ID NO: 4531 - DNA, 23 bp, synthetic construct
  source 1..23: mol_type = other DNA
gcgrgcaggggccccgtgctggg

SEQ ID NO: 4532 - DNA, 23 bp, synthetic construct
  source 1..23: mol_type = other DNA
ggcgrgcaggggccccgtgctgg

SEQ ID NO: 4533 - DNA, 23 bp, synthetic construct
  source 1..23: mol_type = other DNA
tgtccrgttcagctggcgcacgg

SEQ ID NO: 4534 - DNA, 23 bp, synthetic construct
  source 1..23: mol_type = other DNA
cccgcggtgtgccgyaaggagcc

SEQ ID NO: 4535 - DNA, 23 bp, synthetic construct
  source 1..23: mol_type = other DNA
gtgaaatragggcacatattcgg

SEQ ID NO: 4536 - DNA, 23 bp, synthetic construct
  source 1..23: mol_type = other DNA
ccagttctgtccactttgcygtt

SEQ ID NO: 4537 - DNA, 23 bp, synthetic construct
  source 1..23: mol_type = other DNA
accrcccacaaccctatcgctgg

SEQ ID NO: 4538 - DNA, 23 bp, synthetic construct
  source 1..23: mol_type = other DNA
ccttttctggatgtttygcatca

SEQ ID NO: 4539 - DNA, 23 bp, synthetic construct
  source 1..23: mol_type = other DNA
cccccagtggccccccayaggga

SEQ ID NO: 4540 - DNA, 23 bp, synthetic construct
  source 1..23: mol_type = other DNA
ccccagtggccccccayagggag

SEQ ID NO: 4541 - DNA, 23 bp, synthetic construct
  source 1..23: mol_type = other DNA
cccagtggccccccayagggagt

SEQ ID NO: 4542 - DNA, 23 bp, synthetic construct
  source 1..23: mol_type = other DNA
ccagtggccccccayagggagtg

SEQ ID NO: 4543 - DNA, 23 bp, synthetic construct
  source 1..23: mol_type = other DNA
ccccgggggagcagaccyaggct

SEQ ID NO: 4544 - DNA, 23 bp, synthetic construct
  source 1..23: mol_type = other DNA
cccgggggagcagaccyaggctg

SEQ ID NO: 4545 - DNA, 23 bp, synthetic construct
  source 1..23: mol_type = other DNA
ccgggggagcagaccyaggctgt

SEQ ID NO: 4546 - DNA, 23 bp, synthetic construct
  source 1..23: mol_type = other DNA
ccggggaattgcctgtgcaygct

SEQ ID NO: 4547 - DNA, 23 bp, synthetic construct
  source 1..23: mol_type = other DNA
ccacaccgcagcggygacagctg

SEQ ID NO: 4548 - DNA, 23 bp, synthetic construct
  source 1..23: mol_type = other DNA
ccaacaatttcgtgtgygagatt

SEQ ID NO: 4549 - DNA, 23 bp, synthetic construct
  source 1..23: mol_type = other DNA
accrgcagtctccttcgatgtgg

SEQ ID NO: 4550 - DNA, 23 bp, synthetic construct
  source 1..23: mol_type = other DNA
ccgcactgatgcttacgtayggg

SEQ ID NO: 4551 - DNA, 23 bp, synthetic construct
  source 1..23: mol_type = other DNA
cctgggcaatcacagaacayccc

SEQ ID NO: 4552 - DNA, 23 bp, synthetic construct
  source 1..23: mol_type = other DNA
cccttgaggtccacyaggcttat

SEQ ID NO: 4553 - DNA, 23 bp, synthetic construct
  source 1..23: mol_type = other DNA
ccctgtcctccgcaggyccgcca

SEQ ID NO: 4554 - DNA, 23 bp, synthetic construct
  source 1..23: mol_type = other DNA
cctgtcctccgcaggyccgccag

SEQ ID NO: 4555 - DNA, 23 bp, synthetic construct
  source 1..23: mol_type = other DNA
tatatgcraatctataagaaagg

SEQ ID NO: 4556 - DNA, 23 bp, synthetic construct
  source 1..23: mol_type = other DNA
acctcaggracaaagagatctgg

SEQ ID NO: 4557 - DNA, 23 bp, synthetic construct
  source 1..23: mol_type = other DNA
cccccagcttccacagcgyggca

SEQ ID NO: 4558 - DNA, 23 bp, synthetic construct
  source 1..23: mol_type = other DNA
ccccagcttccacagcgyggcac

SEQ ID NO: 4559 - DNA, 23 bp, synthetic construct
  source 1..23: mol_type = other DNA
cccagcttccacagcgyggcacc

SEQ ID NO: 4560 - DNA, 23 bp, synthetic construct
  source 1..23: mol_type = other DNA
ccagcttccacagcgyggcacct

SEQ ID NO: 4561 - DNA, 23 bp, synthetic construct
  source 1..23: mol_type = other DNA
cccagccacttcagcygaggctc

SEQ ID NO: 4562 - DNA, 23 bp, synthetic construct
  source 1..23: mol_type = other DNA
ccagccacttcagcygaggctcc

SEQ ID NO: 4563 - DNA, 23 bp, synthetic construct
  source 1..23: mol_type = other DNA
agatgrtgagtcttcttgcgtgg

SEQ ID NO: 4564 - DNA, 23 bp, synthetic construct
  source 1..23: mol_type = other DNA
ccaactgccacaatacyaactaa

SEQ ID NO: 4565 - DNA, 23 bp, synthetic construct
  source 1..23: mol_type = other DNA
aagrtaagctggcgctccctcgg

SEQ ID NO: 4566 - DNA, 23 bp, synthetic construct
  source 1..23: mol_type = other DNA
cccttgatgtcctgyaaatgaag

SEQ ID NO: 4567 - DNA, 23 bp, synthetic construct
  source 1..23: mol_type = other DNA
accrgcgagaactctttcttagg

SEQ ID NO: 4568 - DNA, 23 bp, synthetic construct
  source 1..23: mol_type = other DNA
ggtggagcrctttagtcaggagg

SEQ ID NO: 4569 - DNA, 23 bp, synthetic construct
  source 1..23: mol_type = other DNA
cctgagaagaaaactcyttctac

SEQ ID NO: 4570 - DNA, 23 bp, synthetic construct
  source 1..23: mol_type = other DNA
cctggcataagacctytcttctt

SEQ ID NO: 4571 - DNA, 23 bp, synthetic construct
  source 1..23: mol_type = other DNA
ccacagcccgggggtgcccyaca

SEQ ID NO: 4572 - DNA, 23 bp, synthetic construct
  source 1..23: mol_type = other DNA
ccgcaggtcatttgccyactctc

SEQ ID NO: 4573 - DNA, 23 bp, synthetic construct
  source 1..23: mol_type = other DNA
cctttcaacagtctyagcaaccc

SEQ ID NO: 4574 - DNA, 23 bp, synthetic construct
  source 1..23: mol_type = other DNA
cctcgcggcaccacctyagtcgg

SEQ ID NO: 4575 - DNA, 23 bp, synthetic construct
  source 1..23: mol_type = other DNA
gactrtccccctgggtacttcgg

SEQ ID NO: 4576 - DNA, 23 bp, synthetic construct
  source 1..23: mol_type = other DNA
ccgccgggaaggcatcygccagt

SEQ ID NO: 4577 - DNA, 23 bp, synthetic construct
  source 1..23: mol_type = other DNA
ccgcttctccaacccaygaatgc

SEQ ID NO: 4578 - DNA, 23 bp, synthetic construct
  source 1..23: mol_type = other DNA
agaacrccaatgtggtggtgcgg

SEQ ID NO: 4579 - DNA, 23 bp, synthetic construct
  source 1..23: mol_type = other DNA
gaccrtgggccttctggcggtgg

SEQ ID NO: 4580 - DNA, 23 bp, synthetic construct
  source 1..23: mol_type = other DNA
gatgaccrtgggccttctggcgg

SEQ ID NO: 4581 - DNA, 23 bp, synthetic construct
  source 1..23: mol_type = other DNA
gtgrgagatgccccaggtcaggg

SEQ ID NO: 4582 - DNA, 23 bp, synthetic construct
  source 1..23: mol_type = other DNA
agtgrgagatgccccaggtcagg

SEQ ID NO: 4583 - DNA, 23 bp, synthetic construct
  source 1..23: mol_type = other DNA
cctccrctcccttgtgcccttgg

SEQ ID NO: 4584 - DNA, 23 bp, synthetic construct
  source 1..23: mol_type = other DNA
aggcattgrggacgagatcgagg

SEQ ID NO: 4585 - DNA, 23 bp, synthetic construct
  source 1..23: mol_type = other DNA
gttacaargcacgcgggttgggg

SEQ ID NO: 4586 - DNA, 23 bp, synthetic construct
  source 1..23: mol_type = other DNA
ggttacaargcacgcgggttggg

SEQ ID NO: 4587 - DNA, 23 bp, synthetic construct
  source 1..23: mol_type = other DNA
ggtcrtctacctgtacaccgtgg

SEQ ID NO: 4588 - DNA, 23 bp, synthetic construct
  source 1..23: mol_type = other DNA
cctgccgcagccgccgctycatg

SEQ ID NO: 4589 - DNA, 23 bp, synthetic construct
  source 1..23: mol_type = other DNA
ccgcagccgccgctycatgctct

SEQ ID NO: 4590 - DNA, 23 bp, synthetic construct
  source 1..23: mol_type = other DNA
ccagcagagcctggcgyacagtc

SEQ ID NO: 4591 - DNA, 23 bp, synthetic construct
  source 1..23: mol_type = other DNA
ccctcagtgttacctgtttyaca

SEQ ID NO: 4592 - DNA, 23 bp, synthetic construct
  source 1..23: mol_type = other DNA
cctcagtgttacctgtttyacat

SEQ ID NO: 4593 - DNA, 23 bp, synthetic construct
  source 1..23: mol_type = other DNA
cctgaatatgtgtgcgyccaccg

SEQ ID NO: 4594 - DNA, 23 bp, synthetic construct
  source 1..23: mol_type = other DNA
ccatgccatcctgctcyggcatg

SEQ ID NO: 4595 - DNA, 23 bp, synthetic construct
  source 1..23: mol_type = other DNA
ccttcaacttcttcygcaagttc

SEQ ID NO: 4596 - DNA, 23 bp, synthetic construct
  source 1..23: mol_type = other DNA
ccacccccacgctgcccygactc

SEQ ID NO: 4597 - DNA, 23 bp, synthetic construct
  source 1..23: mol_type = other DNA
cccccacgctgcccygactccct

SEQ ID NO: 4598 - DNA, 23 bp, synthetic construct
  source 1..23: mol_type = other DNA
cctggaggaaagcayaggctaca

SEQ ID NO: 4599 - DNA, 23 bp, synthetic construct
  source 1..23: mol_type = other DNA
ccgactggtgctcaacaygccgt

SEQ ID NO: 4600 - DNA, 23 bp, synthetic construct
  source 1..23: mol_type = other DNA
tcattgrtggtgatgtcctcagg

SEQ ID NO: 4601 - DNA, 23 bp, synthetic construct
  source 1..23: mol_type = other DNA
ttcrtgctggaggagggatcggg

SEQ ID NO: 4602 - DNA, 23 bp, synthetic construct
  source 1..23: mol_type = other DNA
gttcrtgctggaggagggatcgg

SEQ ID NO: 4603 - DNA, 23 bp, synthetic construct
  source 1..23: mol_type = other DNA
ccacatggggaacgygatcatga

SEQ ID NO: 4604 - DNA, 23 bp, synthetic construct
  source 1..23: mol_type = other DNA
ccctcagaactattttgctygca

SEQ ID NO: 4605 - DNA, 23 bp, synthetic construct
  source 1..23: mol_type = other DNA
cctcagaactattttgctygcaa

SEQ ID NO: 4606 - DNA, 23 bp, synthetic construct
  source 1..23: mol_type = other DNA
cccagcatgaagaatcaygcaca

SEQ ID NO: 4607 - DNA, 23 bp, synthetic construct
  source 1..23: mol_type = other DNA
ccagcatgaagaatcaygcacag

SEQ ID NO: 4608 - DNA, 23 bp, synthetic construct
  source 1..23: mol_type = other DNA
ccatgrtgcggaggactcgctgg

SEQ ID NO: 4609 - DNA, 23 bp, synthetic construct
  source 1..23: mol_type = other DNA
gaacraatggatttgttatctgg

SEQ ID NO: 4610 - DNA, 23 bp, synthetic construct
  source 1..23: mol_type = other DNA
cctgctttgaaaagcttyaaaca

SEQ ID NO: 4611 - DNA, 23 bp, synthetic construct
  source 1..23: mol_type = other DNA
cccacaggagctccgtgygatta

SEQ ID NO: 4612 - DNA, 23 bp, synthetic construct
  source 1..23: mol_type = other DNA
ccacaggagctccgtgygattac

SEQ ID NO: 4613 - DNA, 23 bp, synthetic construct
  source 1..23: mol_type = other DNA
cccccaatccagctacctyagag

SEQ ID NO: 4614 - DNA, 23 bp, synthetic construct
  source 1..23: mol_type = other DNA
ccccaatccagctacctyagagc

SEQ ID NO: 4615 - DNA, 23 bp, synthetic construct
  source 1..23: mol_type = other DNA
cccaatccagctacctyagagca

SEQ ID NO: 4616 - DNA, 23 bp, synthetic construct
  source 1..23: mol_type = other DNA
ccaatccagctacctyagagcag

SEQ ID NO: 4617 - DNA, 23 bp, synthetic construct
  source 1..23: mol_type = other DNA
cccagctgtttgatgtatygaag

SEQ ID NO: 4618 - DNA, 23 bp, synthetic construct
  source 1..23: mol_type = other DNA
ccagctgtttgatgtatygaaga

SEQ ID NO: 4619 - DNA, 23 bp, synthetic construct
  source 1..23: mol_type = other DNA
ccaggagcttcacacaatygatt

SEQ ID NO: 4620 - DNA, 23 bp, synthetic construct
  source 1..23: mol_type = other DNA
cctcaatttcaacgtcttygata

SEQ ID NO: 4621 - DNA, 23 bp, synthetic construct
  source 1..23: mol_type = other DNA
ccagagaaatttgcagagyagct

SEQ ID NO: 4622 - DNA, 23 bp, synthetic construct
  source 1..23: mol_type = other DNA
ttggtctcrttcaaaaacatagg

SEQ ID NO: 4623 - DNA, 23 bp, synthetic construct
  source 1..23: mol_type = other DNA
ggcacgtrtgcctgcgagccggg

SEQ ID NO: 4624 - DNA, 23 bp, synthetic construct
  source 1..23: mol_type = other DNA
cggcacgtrtgcctgcgagccgg

SEQ ID NO: 4625 - DNA, 23 bp, synthetic construct
  source 1..23: mol_type = other DNA
aacacacrgaaggtacgcagggg

SEQ ID NO: 4626 - DNA, 23 bp, synthetic construct
  source 1..23: mol_type = other DNA
gaacacacrgaaggtacgcaggg

SEQ ID NO: 4627 - DNA, 23 bp, synthetic construct
  source 1..23: mol_type = other DNA
tgggactrtatggaggttgctgg

SEQ ID NO: 4628 - DNA, 23 bp, synthetic construct
  source 1..23: mol_type = other DNA
aacargatatcattatttcctgg

SEQ ID NO: 4629 - DNA, 23 bp, synthetic construct
  source 1..23: mol_type = other DNA
catgrtgattggaaacctagtgg

SEQ ID NO: 4630 - DNA, 23 bp, synthetic construct
  source 1..23: mol_type = other DNA
ctggraaaatctttatcaactgg

SEQ ID NO: 4631 - DNA, 23 bp, synthetic construct
  source 1..23: mol_type = other DNA
cttgtttcractaatgactcagg

SEQ ID NO: 4632 - DNA, 23 bp, synthetic construct
  source 1..23: mol_type = other DNA
tccvcgtgctgtgtggggagtgg

SEQ ID NO: 4633 - DNA, 23 bp, synthetic construct
  source 1..23: mol_type = other DNA
tgtgttccvcgtgctgtgtgggg

SEQ ID NO: 4634 - DNA, 23 bp, synthetic construct
  source 1..23: mol_type = other DNA
tgttctccrttcatttcgattgg

SEQ ID NO: 4635 - DNA, 23 bp, synthetic construct
  source 1..23: mol_type = other DNA
cctggattcttcaagtthtagat

SEQ ID NO: 4636 - DNA, 23 bp, synthetic construct
  source 1..23: mol_type = other DNA
ccttttcagctttagagggygag

SEQ ID NO: 4637 - DNA, 23 bp, synthetic construct
  source 1..23: mol_type = other DNA
cctggttgtgatggaccyatttg

SEQ ID NO: 4638 - DNA, 23 bp, synthetic construct
  source 1..23: mol_type = other DNA
ccttgtttgtgcccygacgacac

SEQ ID NO: 4639 - DNA, 23 bp, synthetic construct
  source 1..23: mol_type = other DNA
ccatcttccggttcagtgycacc

SEQ ID NO: 4640 - DNA, 23 bp, synthetic construct
  source 1..23: mol_type = other DNA
ccggttcagtgccayctctgccc

SEQ ID NO: 4641 - DNA, 23 bp, synthetic construct
  source 1..23: mol_type = other DNA
ccgagcattgaagabgatttcag

SEQ ID NO: 4642 - DNA, 23 bp, synthetic construct
  source 1..23: mol_type = other DNA
ccttcccaaaggcaaygagcaat

SEQ ID NO: 4643 - DNA, 23 bp, synthetic construct
  source 1..23: mol_type = other DNA
ccttggttggtggacyttcagtt

SEQ ID NO: 4644 - DNA, 23 bp, synthetic construct
  source 1..23: mol_type = other DNA
ccctgcarccaacagagacatgg

SEQ ID NO: 4645 - DNA, 23 bp, synthetic construct
  source 1..23: mol_type = other DNA
ggaggtgractcggagaccgagg

SEQ ID NO: 4646 - DNA, 23 bp, synthetic construct
  source 1..23: mol_type = other DNA
tgagcrcttcgagggccgcgtgg

SEQ ID NO: 4647 - DNA, 23 bp, synthetic construct
  source 1..23: mol_type = other DNA
ttccrgctggtaaattaactggg

SEQ ID NO: 4648 - DNA, 23 bp, synthetic construct
  source 1..23: mol_type = other DNA
attccrgctggtaaattaactgg

SEQ ID NO: 4649 - DNA, 23 bp, synthetic construct
  source 1..23: mol_type = other DNA
catcrtcttcatttttgctgtgg

SEQ ID NO: 4650 - DNA, 23 bp, synthetic construct
  source 1..23: mol_type = other DNA
gtcccrgtttgaaggaatgaggg

SEQ ID NO: 4651 - DNA, 23 bp, synthetic construct
  source 1..23: mol_type = other DNA
tgtcccrgtttgaaggaatgagg

SEQ ID NO: 4652 - DNA, 23 bp, synthetic construct
  source 1..23: mol_type = other DNA
ccttcctgatcgtgttcygcgtg

SEQ ID NO: 4653 - DNA, 23 bp, synthetic construct
  source 1..23: mol_type = other DNA
ccaggttgttgtaaatgctyttt

SEQ ID NO: 4654 - DNA, 23 bp, synthetic construct
  source 1..23: mol_type = other DNA
ccaggggaaacaatytattgaag

SEQ ID NO: 4655 - DNA, 23 bp, synthetic construct
  source 1..23: mol_type = other DNA
tccrtgtgatccgcctggcgcgg

SEQ ID NO: 4656 - DNA, 23 bp, synthetic construct
  source 1..23: mol_type = other DNA
gctgttccrtgtgatccgcctgg

SEQ ID NO: 4657 - DNA, 23 bp, synthetic construct
  source 1..23: mol_type = other DNA
gcagctgcrggtcttcaagctgg

SEQ ID NO: 4658 - DNA, 23 bp, synthetic construct
  source 1..23: mol_type = other DNA
tgcrggccctgcgtcccctgagg

SEQ ID NO: 4659 - DNA, 23 bp, synthetic construct
  source 1..23: mol_type = other DNA
tgtgctacrctccttccgtctgg

SEQ ID NO: 4660 - DNA, 23 bp, synthetic construct
  source 1..23: mol_type = other DNA
cagcacccrgaaggtcctcaggg

SEQ ID NO: 4661 - DNA, 23 bp, synthetic construct
  source 1..23: mol_type = other DNA
ccctcctaggcgccatcycctcc

SEQ ID NO: 4662 - DNA, 23 bp, synthetic construct
  source 1..23: mol_type = other DNA
cctcctaggcgccatcycctcca

SEQ ID NO: 4663 - DNA, 23 bp, synthetic construct
  source 1..23: mol_type = other DNA
cactcaraccacgccatcggagg

SEQ ID NO: 4664 - DNA, 23 bp, synthetic construct
  source 1..23: mol_type = other DNA
ctgrgagcgcctctatcagcagg

SEQ ID NO: 4665 - DNA, 23 bp, synthetic construct
  source 1..23: mol_type = other DNA
cgtgartgtgggcacccgaaggg

SEQ ID NO: 4666 - DNA, 23 bp, synthetic construct
  source 1..23: mol_type = other DNA
acgtgartgtgggcacccgaagg

SEQ ID NO: 4667 - DNA, 23 bp, synthetic construct
  source 1..23: mol_type = other DNA
gagccragaggggctgcccgagg

SEQ ID NO: 4668 - DNA, 23 bp, synthetic construct
  source 1..23: mol_type = other DNA
tgcccraggaggaggctccccgg

SEQ ID NO: 4669 - DNA, 23 bp, synthetic construct
  source 1..23: mol_type = other DNA
caacrgcaccaacggctccgtgg

SEQ ID NO: 4670 - DNA, 23 bp, synthetic construct
  source 1..23: mol_type = other DNA
aacrgctccgtggaggccgacgg

SEQ ID NO: 4671 - DNA, 23 bp, synthetic construct
  source 1..23: mol_type = other DNA
ctccrtggaggccgacggcttgg

SEQ ID NO: 4672 - DNA, 23 bp, synthetic construct
  source 1..23: mol_type = other DNA
cggcttgrtctgggaatccctgg

SEQ ID NO: 4673 - DNA, 23 bp, synthetic construct
  source 1..23: mol_type = other DNA
ctgggagcrcctctatcagcagg

SEQ ID NO: 4674 - DNA, 23 bp, synthetic construct
  source 1..23: mol_type = other DNA
cgtggtcrcaatggcctatgagg

SEQ ID NO: 4675 - DNA, 23 bp, synthetic construct
  source 1..23: mol_type = other DNA
gcttcraggagccaggagcacgg

SEQ ID NO: 4676 - DNA, 23 bp, synthetic construct
  source 1..23: mol_type = other DNA
catcrtcatccttagcctcatgg

SEQ ID NO: 4677 - DNA, 23 bp, synthetic construct
  source 1..23: mol_type = other DNA
tccdcatcctctgtggagagtgg

SEQ ID NO: 4678 - DNA, 23 bp, synthetic construct
  source 1..23: mol_type = other DNA
aggccractggcggcagcagtgg

SEQ ID NO: 4679 - DNA, 23 bp, synthetic construct
  source 1..23: mol_type = other DNA
agaggagcrgaagaccatcaagg

SEQ ID NO: 4680 - DNA, 23 bp, synthetic construct
  source 1..23: mol_type = other DNA
tgggcrtgaacctctttgcgggg

SEQ ID NO: 4681 - DNA, 23 bp, synthetic construct
  source 1..23: mol_type = other DNA
atgggcrtgaacctctttgcggg

SEQ ID NO: 4682 - DNA, 23 bp, synthetic construct
  source 1..23: mol_type = other DNA
catgggcrtgaacctctttgcgg

SEQ ID NO: 4683 - DNA, 23 bp, synthetic construct
  source 1..23: mol_type = other DNA
cttcrcttatgtcaagtgggagg

SEQ ID NO: 4684 - DNA, 23 bp, synthetic construct
  source 1..23: mol_type = other DNA
caacttcrcttatgtcaagtggg

SEQ ID NO: 4685 - DNA, 23 bp, synthetic construct
  source 1..23: mol_type = other DNA
ccaacttcrcttatgtcaagtgg

SEQ ID NO: 4686 - DNA, 23 bp, synthetic construct
  source 1..23: mol_type = other DNA
ctcatcrtagacgtgagtgtggg

SEQ ID NO: 4687 - DNA, 23 bp, synthetic construct
  source 1..23: mol_type = other DNA
cctcatcrtagacgtgagtgtgg

SEQ ID NO: 4688 - DNA, 23 bp, synthetic construct
  source 1..23: mol_type = other DNA
ccgcrgctcaaccaccttgcagg

SEQ ID NO: 4689 - DNA, 23 bp, synthetic construct
  source 1..23: mol_type = other DNA
ctccttgragatgtcccctttgg

SEQ ID NO: 4690 - DNA, 23 bp, synthetic construct
  source 1..23: mol_type = other DNA
ttcraggagatgctgcaggtcgg

SEQ ID NO: 4691 - DNA, 23 bp, synthetic construct
  source 1..23: mol_type = other DNA
tgaattcraggagatgctgcagg

SEQ ID NO: 4692 - DNA, 23 bp, synthetic construct
  source 1..23: mol_type = other DNA
ccagctgcrggtcttcaagctgg

SEQ ID NO: 4693 - DNA, 23 bp, synthetic construct
  source 1..23: mol_type = other DNA
cacagrccccagggaaggtctgg

SEQ ID NO: 4694 - DNA, 23 bp, synthetic construct
  source 1..23: mol_type = other DNA
tcctcrtctgcctcatcttctgg

SEQ ID NO: 4695 - DNA, 23 bp, synthetic construct
  source 1..23: mol_type = other DNA
gggcagcrgcctctccgaagagg

SEQ ID NO: 4696 - DNA, 23 bp, synthetic construct
  source 1..23: mol_type = other DNA
ggcrggtgctctagcatcacagg

SEQ ID NO: 4697 - DNA, 23 bp, synthetic construct
  source 1..23: mol_type = other DNA
gagcaccragcccctgagtgagg

SEQ ID NO: 4698 - DNA, 23 bp, synthetic construct
  source 1..23: mol_type = other DNA
cccggggtggtaggtgccayata

SEQ ID NO: 4699 - DNA, 23 bp, synthetic construct
  source 1..23: mol_type = other DNA
ccggggtggtaggtgccayatac

SEQ ID NO: 4700 - DNA, 23 bp, synthetic construct
  source 1..23: mol_type = other DNA
ccctggtgggcgccatcycgtcc

SEQ ID NO: 4701 - DNA, 23 bp, synthetic construct
  source 1..23: mol_type = other DNA
cctggtgggcgccatcycgtcca

SEQ ID NO: 4702 - DNA, 23 bp, synthetic construct
  source 1..23: mol_type = other DNA
ccttccgagtcctcygggccctg

SEQ ID NO: 4703 - DNA, 23 bp, synthetic construct
  source 1..23: mol_type = other DNA
cctttcttgcactcttcygcctg

SEQ ID NO: 4704 - DNA, 23 bp, synthetic construct
  source 1..23: mol_type = other DNA
ccccaggaagccacctcytccgc

SEQ ID NO: 4705 - DNA, 23 bp, synthetic construct
  source 1..23: mol_type = other DNA
cccaggaagccacctcytccgcc

SEQ ID NO: 4706 - DNA, 23 bp, synthetic construct
  source 1..23: mol_type = other DNA
ccaggaagccacctcytccgccc

SEQ ID NO: 4707 - DNA, 23 bp, synthetic construct
  source 1..23: mol_type = other DNA
cctgattgcactcagaccaygcc

SEQ ID NO: 4708 - DNA, 23 bp, synthetic construct
  source 1..23: mol_type = other DNA
ccaggagcacggcagygggccct

SEQ ID NO: 4709 - DNA, 23 bp, synthetic construct
  source 1..23: mol_type = other DNA
ccttcctcatcatcttcygcatc

SEQ ID NO: 4710 - DNA, 23 bp, synthetic construct
  source 1..23: mol_type = other DNA
cctggagccaggtgtcagygact

SEQ ID NO: 4711 - DNA, 23 bp, synthetic construct
  source 1..23: mol_type = other DNA
ccagtgcatctcaggycgactgg

SEQ ID NO: 4712 - DNA, 23 bp, synthetic construct
  source 1..23: mol_type = other DNA
ccacacccctgtccatagayccc

SEQ ID NO: 4713 - DNA, 23 bp, synthetic construct
  source 1..23: mol_type = other DNA
cccctgtccatagaycccagagg

SEQ ID NO: 4714 - DNA, 23 bp, synthetic construct
  source 1..23: mol_type = other DNA
cccataggctgtgtccggygctg

SEQ ID NO: 4715 - DNA, 23 bp, synthetic construct
  source 1..23: mol_type = other DNA
ccataggctgtgtccggygctgt

SEQ ID NO: 4716 - DNA, 23 bp, synthetic construct
  source 1..23: mol_type = other DNA
ccctggtgggcgccatccbgtcc

SEQ ID NO: 4717 - DNA, 23 bp, synthetic construct
  source 1..23: mol_type = other DNA
cctggtgggcgccatccbgtcca

SEQ ID NO: 4718 - DNA, 23 bp, synthetic construct
  source 1..23: mol_type = other DNA
ccaaggggatccgcaygctgctc

SEQ ID NO: 4719 - DNA, 23 bp, synthetic construct
  source 1..23: mol_type = other DNA
ccttccgagtcctccgggycctg

SEQ ID NO: 4720 - DNA, 23 bp, synthetic construct
  source 1..23: mol_type = other DNA
ccgagtcctccgggycctgaaaa

SEQ ID NO: 4721 - DNA, 23 bp, synthetic construct
  source 1..23: mol_type = other DNA
ccctggcccctgcgcbggaccag

SEQ ID NO: 4722 - DNA, 23 bp, synthetic construct
  source 1..23: mol_type = other DNA
cctggcccctgcgcbggaccagt

SEQ ID NO: 4723 - DNA, 23 bp, synthetic construct
  source 1..23: mol_type = other DNA
cccaggaagccacctcctcygcc

SEQ ID NO: 4724 - DNA, 23 bp, synthetic construct
  source 1..23: mol_type = other DNA
ccaggaagccacctcctcygccc

SEQ ID NO: 4725 - DNA, 23 bp, synthetic construct
  source 1..23: mol_type = other DNA
ccaccatgctggaacygtctcgc

SEQ ID NO: 4726 - DNA, 23 bp, synthetic construct
  source 1..23: mol_type = other DNA
cccatcaagtcactgcggaygct

SEQ ID NO: 4727 - DNA, 23 bp, synthetic construct
  source 1..23: mol_type = other DNA
ccatcaagtcactgcggaygctg

SEQ ID NO: 4728 - DNA, 23 bp, synthetic construct
  source 1..23: mol_type = other DNA
cccttctccggacagggacygtg

SEQ ID NO: 4729 - DNA, 23 bp, synthetic construct
  source 1..23: mol_type = other DNA
ccttctccggacagggacygtga

SEQ ID NO: 4730 - DNA, 23 bp, synthetic construct
  source 1..23: mol_type = other DNA
cccgaaggaaagtgaacgygtgc

SEQ ID NO: 4731 - DNA, 23 bp, synthetic construct
  source 1..23: mol_type = other DNA
ccgaaggaaagtgaacgygtgca

SEQ ID NO: 4732 - DNA, 23 bp, synthetic construct
  source 1..23: mol_type = other DNA
ccctgggcactggtcyggcgcag

SEQ ID NO: 4733 - DNA, 23 bp, synthetic construct
  source 1..23: mol_type = other DNA
cctgggcactggtcyggcgcagg

SEQ ID NO: 4734 - DNA, 23 bp, synthetic construct
  source 1..23: mol_type = other DNA
ccccagaagcccatcccayggcc

SEQ ID NO: 4735 - DNA, 23 bp, synthetic construct
  source 1..23: mol_type = other DNA
cccagaagcccatcccayggccc

SEQ ID NO: 4736 - DNA, 23 bp, synthetic construct
  source 1..23: mol_type = other DNA
ccagaagcccatcccayggcccc

SEQ ID NO: 4737 - DNA, 23 bp, synthetic construct
  source 1..23: mol_type = other DNA
ccagatcaccacgtyggccggct

SEQ ID NO: 4738 - DNA, 23 bp, synthetic construct
  source 1..23: mol_type = other DNA
cctattccragtcatccgattgg

SEQ ID NO: 4739 - DNA, 23 bp, synthetic construct
  source 1..23: mol_type = other DNA
ttagctccragtcttcaaattgg

SEQ ID NO: 4740 - DNA, 23 bp, synthetic construct
  source 1..23: mol_type = other DNA
cctgtggttcggctcctyggtgt

SEQ ID NO: 4741 - DNA, 23 bp, synthetic construct
  source 1..23: mol_type = other DNA
cccatcccaggcaccccgycccc

SEQ ID NO: 4742 - DNA, 23 bp, synthetic construct
  source 1..23: mol_type = other DNA
ccatcccaggcaccccgyccccc

SEQ ID NO: 4743 - DNA, 23 bp, synthetic construct
  source 1..23: mol_type = other DNA
atcragtccaagcaagtggtggg

SEQ ID NO: 4744 - DNA, 23 bp, synthetic construct
  source 1..23: mol_type = other DNA
catcragtccaagcaagtggtgg

SEQ ID NO: 4745 - DNA, 23 bp, synthetic construct
  source 1..23: mol_type = other DNA
gcacatcragtccaagcaagtgg

SEQ ID NO: 4746 - DNA, 23 bp, synthetic construct
  source 1..23: mol_type = other DNA
ggagtggtrggcctggaaacagg

SEQ ID NO: 4747 - DNA, 23 bp, synthetic construct
  source 1..23: mol_type = other DNA
ccctgatgtctgtcyagaagaac

SEQ ID NO: 4748 - DNA, 23 bp, synthetic construct
  source 1..23: mol_type = other DNA
cccccaagtaaaggcttgcygat

SEQ ID NO: 4749 - DNA, 23 bp, synthetic construct
  source 1..23: mol_type = other DNA
ccccaagtaaaggcttgcygatg

SEQ ID NO: 4750 - DNA, 23 bp, synthetic construct
  source 1..23: mol_type = other DNA
cccaagtaaaggcttgcygatgt

SEQ ID NO: 4751 - DNA, 23 bp, synthetic construct
  source 1..23: mol_type = other DNA
ccaagtaaaggcttgcygatgtg

SEQ ID NO: 4752 - DNA, 23 bp, synthetic construct
  source 1..23: mol_type = other DNA
ccaacatggtgaaacccygtttc

SEQ ID NO: 4753 - DNA, 23 bp, synthetic construct
  source 1..23: mol_type = other DNA
cccagraatggtctggaacacgg

SEQ ID NO: 4754 - DNA, 23 bp, synthetic construct
  source 1..23: mol_type = other DNA
cctgaagacgttcgacyggggtg

SEQ ID NO: 4755 - DNA, 23 bp, synthetic construct
  source 1..23: mol_type = other DNA
tcttrtgcaatgaacatcaatgg

SEQ ID NO: 4756 - DNA, 23 bp, synthetic construct
  source 1..23: mol_type = other DNA
cccattctctctatacygctgcc

SEQ ID NO: 4757 - DNA, 23 bp, synthetic construct
  source 1..23: mol_type = other DNA
ccattctctctatacygctgcca

SEQ ID NO: 4758 - DNA, 23 bp, synthetic construct
  source 1..23: mol_type = other DNA
ccttgtctgggtcccatygatag

SEQ ID NO: 4759 - DNA, 23 bp, synthetic construct
  source 1..23: mol_type = other DNA
agatrgctgcgctgttgctgagg

SEQ ID NO: 4760 - DNA, 23 bp, synthetic construct
  source 1..23: mol_type = other DNA
cctggaatgggatcygacacttg

SEQ ID NO: 4761 - DNA, 23 bp, synthetic construct
  source 1..23: mol_type = other DNA
tgcrgtgccctaggaggccgagg

SEQ ID NO: 4762 - DNA, 23 bp, synthetic construct
  source 1..23: mol_type = other DNA
cctcagctctgttgcttygaact

SEQ ID NO: 4763 - DNA, 23 bp, synthetic construct
  source 1..23: mol_type = other DNA
cctgggtctgcttcyggctgctt

SEQ ID NO: 4764 - DNA, 23 bp, synthetic construct
  source 1..23: mol_type = other DNA
ccagcagaatgaagaaygggatg

SEQ ID NO: 4765 - DNA, 23 bp, synthetic construct
  source 1..23: mol_type = other DNA
cccatgcagcaagcaygacctgc

SEQ ID NO: 4766 - DNA, 23 bp, synthetic construct
  source 1..23: mol_type = other DNA
ccatgcagcaagcaygacctgca

SEQ ID NO: 4767 - DNA, 23 bp, synthetic construct
  source 1..23: mol_type = other DNA
cccagagacgcatcygcgtgacc

SEQ ID NO: 4768 - DNA, 23 bp, synthetic construct
  source 1..23: mol_type = other DNA
cctcctcctccaaatgccyagta

SEQ ID NO: 4769 - DNA, 23 bp, synthetic construct
  source 1..23: mol_type = other DNA
cctcctccaaatgccyagtacca

SEQ ID NO: 4770 - DNA, 23 bp, synthetic construct
  source 1..23: mol_type = other DNA
catggtrtgatataataagtggg

SEQ ID NO: 4771 - DNA, 23 bp, synthetic construct
  source 1..23: mol_type = other DNA
acatggtrtgatataataagtgg

SEQ ID NO: 4772 - DNA, 23 bp, synthetic construct
  source 1..23: mol_type = other DNA
cctgctcagagtagcatctygca

SEQ ID NO: 4773 - DNA, 23 bp, synthetic construct
  source 1..23: mol_type = other DNA
cgggctcrgggcaaggttcaggg

SEQ ID NO: 4774 - DNA, 23 bp, synthetic construct
  source 1..23: mol_type = other DNA
ccgggctcrgggcaaggttcagg

SEQ ID NO: 4775 - DNA, 23 bp, synthetic construct
  source 1..23: mol_type = other DNA
gctraggtgaggggcccggctgg

SEQ ID NO: 4776 - DNA, 23 bp, synthetic construct
  source 1..23: mol_type = other DNA
tcctgctraggtgaggggcccgg

SEQ ID NO: 4777 - DNA, 23 bp, synthetic construct
  source 1..23: mol_type = other DNA
ccaatatcttcttctycccagtg

SEQ ID NO: 4778 - DNA, 23 bp, synthetic construct
  source 1..23: mol_type = other DNA
tgatcttcraccacttcacctgg

SEQ ID NO: 4779 - DNA, 23 bp, synthetic construct
  source 1..23: mol_type = other DNA
ccccacacaggctgccyataagg

SEQ ID NO: 4780 - DNA, 23 bp, synthetic construct
  source 1..23: mol_type = other DNA
cccacacaggctgccyataaggc

SEQ ID NO: 4781 - DNA, 23 bp, synthetic construct
  source 1..23: mol_type = other DNA
ccacacaggctgccyataaggct

SEQ ID NO: 4782 - DNA, 23 bp, synthetic construct
  source 1..23: mol_type = other DNA
caagrccaacaggcctttcctgg

SEQ ID NO: 4783 - DNA, 23 bp, synthetic construct
  source 1..23: mol_type = other DNA
ccaaactgaactgcygactctat

SEQ ID NO: 4784 - DNA, 23 bp, synthetic construct
  source 1..23: mol_type = other DNA
cctgtaatgacaccytccagcaa

SEQ ID NO: 4785 - DNA, 23 bp, synthetic construct
  source 1..23: mol_type = other DNA
cccatgtgcatttacygctcccc

SEQ ID NO: 4786 - DNA, 23 bp, synthetic construct
  source 1..23: mol_type = other DNA
ccatgtgcatttacygctccccg

SEQ ID NO: 4787 - DNA, 23 bp, synthetic construct
  source 1..23: mol_type = other DNA
ctgrcccttgtctttggtgaagg

SEQ ID NO: 4788 - DNA, 23 bp, synthetic construct
  source 1..23: mol_type = other DNA
cccccagcccagggctgyagcct

SEQ ID NO: 4789 - DNA, 23 bp, synthetic construct
  source 1..23: mol_type = other DNA
ccccagcccagggctgyagcctg

SEQ ID NO: 4790 - DNA, 23 bp, synthetic construct
  source 1..23: mol_type = other DNA
cccagcccagggctgyagcctgc

SEQ ID NO: 4791 - DNA, 23 bp, synthetic construct
  source 1..23: mol_type = other DNA
ccagcccagggctgyagcctgcc

SEQ ID NO: 4792 - DNA, 23 bp, synthetic construct
  source 1..23: mol_type = other DNA
cctccgccatctctgtggyccgc

SEQ ID NO: 4793 - DNA, 23 bp, synthetic construct
  source 1..23: mol_type = other DNA
ccgccatctctgtggyccgcacc

SEQ ID NO: 4794 - DNA, 23 bp, synthetic construct
  source 1..23: mol_type = other DNA
cctaagcagctccctcygacagt

SEQ ID NO: 4795 - DNA, 23 bp, synthetic construct
  source 1..23: mol_type = other DNA
cctgaaaaagggtcctygtaagg

SEQ ID NO: 4796 - DNA, 23 bp, synthetic construct
  source 1..23: mol_type = other DNA
acgragatggtgagaggtgtggg

SEQ ID NO: 4797 - DNA, 23 bp, synthetic construct
  source 1..23: mol_type = other DNA
cacgragatggtgagaggtgtgg

SEQ ID NO: 4798 - DNA, 23 bp, synthetic construct
  source 1..23: mol_type = other DNA
caatrtgaccctggtgaggaggg

SEQ ID NO: 4799 - DNA, 23 bp, synthetic construct
  source 1..23: mol_type = other DNA
gcaatrtgaccctggtgaggagg

SEQ ID NO: 4800 - DNA, 23 bp, synthetic construct
  source 1..23: mol_type = other DNA
ggtgcaatrtgaccctggtgagg

SEQ ID NO: 4801 - DNA, 23 bp, synthetic construct
  source 1..23: mol_type = other DNA
cctgccccggtggctcygctaca

SEQ ID NO: 4802 - DNA, 23 bp, synthetic construct
  source 1..23: mol_type = other DNA
cccccttcccattgagggcygaa

SEQ ID NO: 4803 - DNA, 23 bp, synthetic construct
  source 1..23: mol_type = other DNA
ccccttcccattgagggcygaaa

SEQ ID NO: 4804 - DNA, 23 bp, synthetic construct
  source 1..23: mol_type = other DNA
cccttcccattgagggcygaaaa

SEQ ID NO: 4805 - DNA, 23 bp, synthetic construct
  source 1..23: mol_type = other DNA
ccttcccattgagggcygaaaag

SEQ ID NO: 4806 - DNA, 23 bp, synthetic construct
  source 1..23: mol_type = other DNA
tcggccrcatggaccaaggtggg

SEQ ID NO: 4807 - DNA, 23 bp, synthetic construct
  source 1..23: mol_type = other DNA
gtcggccrcatggaccaaggtgg

SEQ ID NO: 4808 - DNA, 23 bp, synthetic construct
  source 1..23: mol_type = other DNA
cccccacragacccagaacctgg

SEQ ID NO: 4809 - DNA, 23 bp, synthetic construct
  source 1..23: mol_type = other DNA
ccttttattttccagayagcacc

SEQ ID NO: 4810 - DNA, 23 bp, synthetic construct
  source 1..23: mol_type = other DNA
caaagartaagtttgtttgtggg

SEQ ID NO: 4811 - DNA, 23 bp, synthetic construct
  source 1..23: mol_type = other DNA
ccaaagartaagtttgtttgtgg

SEQ ID NO: 4812 - DNA, 23 bp, synthetic construct
  source 1..23: mol_type = other DNA
ccaccgaggccatttacyggcgc

SEQ ID NO: 4813 - DNA, 23 bp, synthetic construct
  source 1..23: mol_type = other DNA
ccgaggccatttacyggcgctac

SEQ ID NO: 4814 - DNA, 23 bp, synthetic construct
  source 1..23: mol_type = other DNA
cttacarcatcccagcctgaagg

SEQ ID NO: 4815 - DNA, 23 bp, synthetic construct
  source 1..23: mol_type = other DNA
gcccrtctctgcttcctcctggg

SEQ ID NO: 4816 - DNA, 23 bp, synthetic construct
  source 1..23: mol_type = other DNA
tgcccrtctctgcttcctcctgg

SEQ ID NO: 4817 - DNA, 23 bp, synthetic construct
  source 1..23: mol_type = other DNA
cctgccctttgccgagygcctgc

SEQ ID NO: 4818 - DNA, 23 bp, synthetic construct
  source 1..23: mol_type = other DNA
cctctgtccaccatggctgyaga

SEQ ID NO: 4819 - DNA, 23 bp, synthetic construct
  source 1..23: mol_type = other DNA
ccctggctgcccgagagygagct

SEQ ID NO: 4820 - DNA, 23 bp, synthetic construct
  source 1..23: mol_type = other DNA
cctggctgcccgagagygagctc

SEQ ID NO: 4821 - DNA, 23 bp, synthetic construct
  source 1..23: mol_type = other DNA
gtgctgrcggcggacgaccaggg

SEQ ID NO: 4822 - DNA, 23 bp, synthetic construct
  source 1..23: mol_type = other DNA
cgtgctgrcggcggacgaccagg

SEQ ID NO: 4823 - DNA, 23 bp, synthetic construct
  source 1..23: mol_type = other DNA
cggrctcggggccgccttccggg

SEQ ID NO: 4824 - DNA, 23 bp, synthetic construct
  source 1..23: mol_type = other DNA
tcggrctcggggccgccttccgg

SEQ ID NO: 4825 - DNA, 23 bp, synthetic construct
  source 1..23: mol_type = other DNA
cgggraccgcgtgctggcggcgg

SEQ ID NO: 4826 - DNA, 23 bp, synthetic construct
  source 1..23: mol_type = other DNA
ccccgggraccgcgtgctggcgg

SEQ ID NO: 4827 - DNA, 23 bp, synthetic construct
  source 1..23: mol_type = other DNA
ccgcctgrcgcacgcgctcctgg

SEQ ID NO: 4828 - DNA, 23 bp, synthetic construct
  source 1..23: mol_type = other DNA
ccacggtgcacctggagyagggc

SEQ ID NO: 4829 - DNA, 23 bp, synthetic construct
  source 1..23: mol_type = other DNA
ccggagagccaagtgcygcaaac

SEQ ID NO: 4830 - DNA, 23 bp, synthetic construct
  source 1..23: mol_type = other DNA
cttttgrcatccagattcgacgg

SEQ ID NO: 4831 - DNA, 23 bp, synthetic construct
  source 1..23: mol_type = other DNA
ccccttccacgcccctgcayaga

SEQ ID NO: 4832 - DNA, 23 bp, synthetic construct
  source 1..23: mol_type = other DNA
cccttccacgcccctgcayagag

SEQ ID NO: 4833 - DNA, 23 bp, synthetic construct
  source 1..23: mol_type = other DNA
ccttccacgcccctgcayagagc

SEQ ID NO: 4834 - DNA, 23 bp, synthetic construct
  source 1..23: mol_type = other DNA
ccaatatgaggacaagttcygaa

SEQ ID NO: 4835 - DNA, 23 bp, synthetic construct
  source 1..23: mol_type = other DNA
ccagcctggagctgyaggatggt

SEQ ID NO: 4836 - DNA, 23 bp, synthetic construct
  source 1..23: mol_type = other DNA
ccgtgggcaaatatygggtgcgc

SEQ ID NO: 4837 - DNA, 23 bp, synthetic construct
  source 1..23: mol_type = other DNA
cggcgrctccagggcccccccgg

SEQ ID NO: 4838 - DNA, 23 bp, synthetic construct
  source 1..23: mol_type = other DNA
tccrccgaggccgctgcccaggg

SEQ ID NO: 4839 - DNA, 23 bp, synthetic construct
  source 1..23: mol_type = other DNA
gtccrccgaggccgctgcccagg

SEQ ID NO: 4840 - DNA, 23 bp, synthetic construct
  source 1..23: mol_type = other DNA
cccgagtggttctgactygctct

SEQ ID NO: 4841 - DNA, 23 bp, synthetic construct
  source 1..23: mol_type = other DNA
ccgagtggttctgactygctcta

SEQ ID NO: 4842 - DNA, 23 bp, synthetic construct
  source 1..23: mol_type = other DNA
aagatccrtgtgttcgtaggcgg

SEQ ID NO: 4843 - DNA, 23 bp, synthetic construct
  source 1..23: mol_type = other DNA
cctacttcctcatctccyggagt

SEQ ID NO: 4844 - DNA, 23 bp, synthetic construct
  source 1..23: mol_type = other DNA
cctttggctacaacaygatcgat

SEQ ID NO: 4845 - DNA, 23 bp, synthetic construct
  source 1..23: mol_type = other DNA
ccgagggactagagygagtccta

SEQ ID NO: 4846 - DNA, 23 bp, synthetic construct
  source 1..23: mol_type = other DNA
cccaactggagacccygattccg

SEQ ID NO: 4847 - DNA, 23 bp, synthetic construct
  source 1..23: mol_type = other DNA
ccaactggagacccygattccgc

SEQ ID NO: 4848 - DNA, 23 bp, synthetic construct
  source 1..23: mol_type = other DNA
tcccrtcccggtcagggtggcgg

SEQ ID NO: 4849 - DNA, 23 bp, synthetic construct
  source 1..23: mol_type = other DNA
gggtcccrtcccggtcagggtgg

SEQ ID NO: 4850 - DNA, 23 bp, synthetic construct
  source 1..23: mol_type = other DNA
ccatgtgtgtagaactyagaaag

SEQ ID NO: 4851 - DNA, 23 bp, synthetic construct
  source 1..23: mol_type = other DNA
ccagcgctttctggctyagctca

SEQ ID NO: 4852 - DNA, 23 bp, synthetic construct
  source 1..23: mol_type = other DNA
ccgcgcgcggcttcyagcctccc

SEQ ID NO: 4853 - DNA, 23 bp, synthetic construct
  source 1..23: mol_type = other DNA
ccagtgtgctgctctgctygtta

SEQ ID NO: 4854 - DNA, 23 bp, synthetic construct
  source 1..23: mol_type = other DNA
gtgcrgaagctcatgcaggtagg

SEQ ID NO: 4855 - DNA, 23 bp, synthetic construct
  source 1..23: mol_type = other DNA
cacggtgcrgaagctcatgcagg

SEQ ID NO: 4856 - DNA, 23 bp, synthetic construct
  source 1..23: mol_type = other DNA
ccacccccagacgaggccygcag

SEQ ID NO: 4857 - DNA, 23 bp, synthetic construct
  source 1..23: mol_type = other DNA
cccccagacgaggccygcaggga

SEQ ID NO: 4858 - DNA, 23 bp, synthetic construct
  source 1..23: mol_type = other DNA
ccccagacgaggccygcagggac

SEQ ID NO: 4859 - DNA, 23 bp, synthetic construct
  source 1..23: mol_type = other DNA
cctcaggccgtccgagcycttcc

SEQ ID NO: 4860 - DNA, 23 bp, synthetic construct
  source 1..23: mol_type = other DNA
cccgtctctccccagggacyggt

SEQ ID NO: 4861 - DNA, 23 bp, synthetic construct
  source 1..23: mol_type = other DNA
ccgtctctccccagggacyggtt

SEQ ID NO: 4862 - DNA, 23 bp, synthetic construct
  source 1..23: mol_type = other DNA
ctgracactgctgcagctggtgg

SEQ ID NO: 4863 - DNA, 23 bp, synthetic construct
  source 1..23: mol_type = other DNA
ggactgracactgctgcagctgg

SEQ ID NO: 4864 - DNA, 23 bp, synthetic construct
  source 1..23: mol_type = other DNA
gccrcttccgccagccacagtgg

SEQ ID NO: 4865 - DNA, 23 bp, synthetic construct
  source 1..23: mol_type = other DNA
agaccagcrcggggcgcgggcgg

SEQ ID NO: 4866 - DNA, 23 bp, synthetic construct
  source 1..23: mol_type = other DNA
cctgaaggccatcgcctycctgc

SEQ ID NO: 4867 - DNA, 23 bp, synthetic construct
  source 1..23: mol_type = other DNA
tttgccccrgcgctattccatgg

SEQ ID NO: 4868 - DNA, 23 bp, synthetic construct
  source 1..23: mol_type = other DNA
ccccratggctcatctctcaggg

SEQ ID NO: 4869 - DNA, 23 bp, synthetic construct
  source 1..23: mol_type = other DNA
cccccratggctcatctctcagg

SEQ ID NO: 4870 - DNA, 23 bp, synthetic construct
  source 1..23: mol_type = other DNA
ccaactatgtggcagyatttgtc

SEQ ID NO: 4871 - DNA, 23 bp, synthetic construct
  source 1..23: mol_type = other DNA
cctcggccacgccagcgyccagg

SEQ ID NO: 4872 - DNA, 23 bp, synthetic construct
  source 1..23: mol_type = other DNA
tttcratcctcaccccagtttgg

SEQ ID NO: 4873 - DNA, 23 bp, synthetic construct
  source 1..23: mol_type = other DNA
ccaargtaaccgcgggcccgagg

SEQ ID NO: 4874 - DNA, 23 bp, synthetic construct
  source 1..23: mol_type = other DNA
tcggtgrctatgaactgagccgg

SEQ ID NO: 4875 - DNA, 23 bp, synthetic construct
  source 1..23: mol_type = other DNA
gagttggtrggatttgcctctgg

SEQ ID NO: 4876 - DNA, 23 bp, synthetic construct
  source 1..23: mol_type = other DNA
attcragcattccctgccaatgg

SEQ ID NO: 4877 - DNA, 23 bp, synthetic construct
  source 1..23: mol_type = other DNA
ccctgccaatggagcaytctttt

SEQ ID NO: 4878 - DNA, 23 bp, synthetic construct
  source 1..23: mol_type = other DNA
cctgccaatggagcaytcttttt

SEQ ID NO: 4879 - DNA, 23 bp, synthetic construct
  source 1..23: mol_type = other DNA
ccaggagtttgggatcygaggca

SEQ ID NO: 4880 - DNA, 23 bp, synthetic construct
  source 1..23: mol_type = other DNA
cttggagraattattagctgtgg

SEQ ID NO: 4881 - DNA, 23 bp, synthetic construct
  source 1..23: mol_type = other DNA
tgctgcagrtgaggaccgcgcgg

SEQ ID NO: 4882 - DNA, 23 bp, synthetic construct
  source 1..23: mol_type = other DNA
tgttgragtgagatcactgcggg

SEQ ID NO: 4883 - DNA, 23 bp, synthetic construct
  source 1..23: mol_type = other DNA
ttgttgragtgagatcactgcgg

SEQ ID NO: 4884 - DNA, 23 bp, synthetic construct
  source 1..23: mol_type = other DNA
ccactgctctttcccgcayggcc

SEQ ID NO: 4885 - DNA, 23 bp, synthetic construct
  source 1..23: mol_type = other DNA
cccgtatcactgtctyggattca

SEQ ID NO: 4886 - DNA, 23 bp, synthetic construct
  source 1..23: mol_type = other DNA
ccgtatcactgtctyggattcat

SEQ ID NO: 4887 - DNA, 23 bp, synthetic construct
  source 1..23: mol_type = other DNA
aagacgrccctgatcttcgaggg

SEQ ID NO: 4888 - DNA, 23 bp, synthetic construct
  source 1..23: mol_type = other DNA
caagacgrccctgatcttcgagg

SEQ ID NO: 4889 - DNA, 23 bp, synthetic construct
  source 1..23: mol_type = other DNA
caacrgctacctcagcaccctgg

SEQ ID NO: 4890 - DNA, 23 bp, synthetic construct
  source 1..23: mol_type = other DNA
gtggccrgcagctcaccgcctgg

SEQ ID NO: 4891 - DNA, 23 bp, synthetic construct
  source 1..23: mol_type = other DNA
cctgaagactgtggtcttcyagt

SEQ ID NO: 4892 - DNA, 23 bp, synthetic construct
  source 1..23: mol_type = other DNA
ctttgrccggtaagtaggagagg

SEQ ID NO: 4893 - DNA, 23 bp, synthetic construct
  source 1..23: mol_type = other DNA
aagrtgagtcgcgcgcccgcggg

SEQ ID NO: 4894 - DNA, 23 bp, synthetic construct
  source 1..23: mol_type = other DNA
caagrtgagtcgcgcgcccgcgg

SEQ ID NO: 4895 - DNA, 23 bp, synthetic construct
  source 1..23: mol_type = other DNA
tggctccrgtatcgtcaacacgg

SEQ ID NO: 4896 - DNA, 23 bp, synthetic construct
  source 1..23: mol_type = other DNA
ccgcaacgaggagaacygggcca

SEQ ID NO: 4897 - DNA, 23 bp, synthetic construct
  source 1..23: mol_type = other DNA
ccttcactgtcgtgtyggtgagt

SEQ ID NO: 4898 - DNA, 23 bp, synthetic construct
  source 1..23: mol_type = other DNA
cccagtgctaaagaagctgygcg

SEQ ID NO: 4899 - DNA, 23 bp, synthetic construct
  source 1..23: mol_type = other DNA
ccagtgctaaagaagctgygcgg

SEQ ID NO: 4900 - DNA, 23 bp, synthetic construct
  source 1..23: mol_type = other DNA
ccaattccagctacygacagcct

SEQ ID NO: 4901 - DNA, 23 bp, synthetic construct
  source 1..23: mol_type = other DNA
ccgctgccattctgctayagatg

SEQ ID NO: 4902 - DNA, 23 bp, synthetic construct
  source 1..23: mol_type = other DNA
cggtgcacrggatcttcaactgg

SEQ ID NO: 4903 - DNA, 23 bp, synthetic construct
  source 1..23: mol_type = other DNA
gaagccgraggagagacaggagg

SEQ ID NO: 4904 - DNA, 23 bp, synthetic construct
  source 1..23: mol_type = other DNA
ccagccccaaccgctgcyatgtt

SEQ ID NO: 4905 - DNA, 23 bp, synthetic construct
  source 1..23: mol_type = other DNA
ccttctacaatgtgggcygctca

SEQ ID NO: 4906 - DNA, 23 bp, synthetic construct
  source 1..23: mol_type = other DNA
ttcacgtrgacaaacttcattgg

SEQ ID NO: 4907 - DNA, 23 bp, synthetic construct
  source 1..23: mol_type = other DNA
ccacrccattgtgggactcatgg

SEQ ID NO: 4908 - DNA, 23 bp, synthetic construct
  source 1..23: mol_type = other DNA
gtatttgrtttctcctcgtatgg

SEQ ID NO: 4909 - DNA, 23 bp, synthetic construct
  source 1..23: mol_type = other DNA
ccttcttcctcctaygaaacatc

SEQ ID NO: 4910 - DNA, 23 bp, synthetic construct
  source 1..23: mol_type = other DNA
ccagcacagagaccactcyccag

SEQ ID NO: 4911 - DNA, 23 bp, synthetic construct
  source 1..23: mol_type = other DNA
tcctggrttccctcatggtgggg

SEQ ID NO: 4912 - DNA, 23 bp, synthetic construct
  source 1..23: mol_type = other DNA
ctcctggrttccctcatggtggg

SEQ ID NO: 4913 - DNA, 23 bp, synthetic construct
  source 1..23: mol_type = other DNA
cctcctggrttccctcatggtgg

SEQ ID NO: 4914 - DNA, 23 bp, synthetic construct
  source 1..23: mol_type = other DNA
gaccrggctggccacctcgctgg

SEQ ID NO: 4915 - DNA, 23 bp, synthetic construct
  source 1..23: mol_type = other DNA
ccaggtacgtcgccygcctcagt

SEQ ID NO: 4916 - DNA, 23 bp, synthetic construct
  source 1..23: mol_type = other DNA
ttgctgccracttcattgatggg

SEQ ID NO: 4917 - DNA, 23 bp, synthetic construct
  source 1..23: mol_type = other DNA
ccargttttggaggtgccctggg

SEQ ID NO: 4918 - DNA, 23 bp, synthetic construct
  source 1..23: mol_type = other DNA
tccargttttggaggtgccctgg

SEQ ID NO: 4919 - DNA, 23 bp, synthetic construct
  source 1..23: mol_type = other DNA
ccagagctggcaatgyagggagc

SEQ ID NO: 4920 - DNA, 23 bp, synthetic construct
  source 1..23: mol_type = other DNA
cacagrcctgtccatcctcatgg

SEQ ID NO: 4921 - DNA, 23 bp, synthetic construct
  source 1..23: mol_type = other DNA
gcagcrgatcagtggactcctgg

SEQ ID NO: 4922 - DNA, 23 bp, synthetic construct
  source 1..23: mol_type = other DNA
ctggggragaatggggcctgggg

SEQ ID NO: 4923 - DNA, 23 bp, synthetic construct
  source 1..23: mol_type = other DNA
cctggggragaatggggcctggg

SEQ ID NO: 4924 - DNA, 23 bp, synthetic construct
  source 1..23: mol_type = other DNA
acctggggragaatggggcctgg

SEQ ID NO: 4925 - DNA, 23 bp, synthetic construct
  source 1..23: mol_type = other DNA
atcrtgggccgcgtgtggatcgg

SEQ ID NO: 4926 - DNA, 23 bp, synthetic construct
  source 1..23: mol_type = other DNA
agtacatcrtgggccgcgtgtgg

SEQ ID NO: 4927 - DNA, 23 bp, synthetic construct
  source 1..23: mol_type = other DNA
cccrcggtgcgggttatgctggg

SEQ ID NO: 4928 - DNA, 23 bp, synthetic construct
  source 1..23: mol_type = other DNA
acccrcggtgcgggttatgctgg

SEQ ID NO: 4929 - DNA, 23 bp, synthetic construct
  source 1..23: mol_type = other DNA
ccgatgccccctccgagyaggca

SEQ ID NO: 4930 - DNA, 23 bp, synthetic construct
  source 1..23: mol_type = other DNA
ccaactcctcagccyggggctgg

SEQ ID NO: 4931 - DNA, 23 bp, synthetic construct
  source 1..23: mol_type = other DNA
cctcatcctcactgtgcygctgc

SEQ ID NO: 4932 - DNA, 23 bp, synthetic construct
  source 1..23: mol_type = other DNA
cctcactgtgccgctgyggcgcg

SEQ ID NO: 4933 - DNA, 23 bp, synthetic construct
  source 1..23: mol_type = other DNA
gagacgcrgctgacctcgctggg

SEQ ID NO: 4934 - DNA, 23 bp, synthetic construct
  source 1..23: mol_type = other DNA
ggagacgcrgctgacctcgctgg

SEQ ID NO: 4935 - DNA, 23 bp, synthetic construct
  source 1..23: mol_type = other DNA
cccatccrgtacaggcgggtggg

SEQ ID NO: 4936 - DNA, 23 bp, synthetic construct
  source 1..23: mol_type = other DNA
ccccatccrgtacaggcgggtgg

SEQ ID NO: 4937 - DNA, 23 bp, synthetic construct
  source 1..23: mol_type = other DNA
acacagrgctgtctctgtttggg

SEQ ID NO: 4938 - DNA, 23 bp, synthetic construct
  source 1..23: mol_type = other DNA
aacacagrgctgtctctgtttgg

SEQ ID NO: 4939 - DNA, 23 bp, synthetic construct
  source 1..23: mol_type = other DNA
caatgacragaacacagacgggg

SEQ ID NO: 4940 - DNA, 23 bp, synthetic construct
  source 1..23: mol_type = other DNA
tcaatgacragaacacagacggg

SEQ ID NO: 4941 - DNA, 23 bp, synthetic construct
  source 1..23: mol_type = other DNA
cctgcacccctgcgtgygagaga

SEQ ID NO: 4942 - DNA, 23 bp, synthetic construct
  source 1..23: mol_type = other DNA
ccatgatccccatcyggtacagg

SEQ ID NO: 4943 - DNA, 23 bp, synthetic construct
  source 1..23: mol_type = other DNA
ttcrcctttggattggcctgtgg

SEQ ID NO: 4944 - DNA, 23 bp, synthetic construct
  source 1..23: mol_type = other DNA
ccagaccctaaggcctatyagct

SEQ ID NO: 4945 - DNA, 23 bp, synthetic construct
  source 1..23: mol_type = other DNA
cctgccgttcatgagcyggctgc

SEQ ID NO: 4946 - DNA, 23 bp, synthetic construct
  source 1..23: mol_type = other DNA
ctgrcttcccgtggtgcaggcgg

SEQ ID NO: 4947 - DNA, 23 bp, synthetic construct
  source 1..23: mol_type = other DNA
ggcctgrcttcccgtggtgcagg

SEQ ID NO: 4948 - DNA, 23 bp, synthetic construct
  source 1..23: mol_type = other DNA
cctgaccatcttcctcatcygag

SEQ ID NO: 4949 - DNA, 23 bp, synthetic construct
  source 1..23: mol_type = other DNA
ccatcttcctcatcygaggcctg

SEQ ID NO: 4950 - DNA, 23 bp, synthetic construct
  source 1..23: mol_type = other DNA
gccrtgaaatacaccacctgcgg

SEQ ID NO: 4951 - DNA, 23 bp, synthetic construct
  source 1..23: mol_type = other DNA
ctacagrtgagcccctagcaggg

SEQ ID NO: 4952 - DNA, 23 bp, synthetic construct
  source 1..23: mol_type = other DNA
gctacagrtgagcccctagcagg

SEQ ID NO: 4953 - DNA, 23 bp, synthetic construct
  source 1..23: mol_type = other DNA
cccagcctgtactggyggctgtg

SEQ ID NO: 4954 - DNA, 23 bp, synthetic construct
  source 1..23: mol_type = other DNA
ccagcctgtactggyggctgtgc

SEQ ID NO: 4955 - DNA, 23 bp, synthetic construct
  source 1..23: mol_type = other DNA
cctgtatgatcgggtacygacct

SEQ ID NO: 4956 - DNA, 23 bp, synthetic construct
  source 1..23: mol_type = other DNA
catcagcrggctggtgctcctgg

SEQ ID NO: 4957 - DNA, 23 bp, synthetic construct
  source 1..23: mol_type = other DNA
catcrggatccccctggtgacgg

SEQ ID NO: 4958 - DNA, 23 bp, synthetic construct
  source 1..23: mol_type = other DNA
ccattatcatcgggatccycctg

SEQ ID NO: 4959 - DNA, 23 bp, synthetic construct
  source 1..23: mol_type = other DNA
gggcrgggtgcttgtgggcgtgg

SEQ ID NO: 4960 - DNA, 23 bp, synthetic construct
  source 1..23: mol_type = other DNA
ggacragaccaagctgctggtgg

SEQ ID NO: 4961 - DNA, 23 bp, synthetic construct
  source 1..23: mol_type = other DNA
cggggacragaccaagctgctgg

SEQ ID NO: 4962 - DNA, 23 bp, synthetic construct
  source 1..23: mol_type = other DNA
tcataartatccttaattgaggg

SEQ ID NO: 4963 - DNA, 23 bp, synthetic construct
  source 1..23: mol_type = other DNA
atcataartatccttaattgagg

SEQ ID NO: 4964 - DNA, 23 bp, synthetic construct
  source 1..23: mol_type = other DNA
ccaaattacgggagttcyagttg

SEQ ID NO: 4965 - DNA, 23 bp, synthetic construct
  source 1..23: mol_type = other DNA
tggattgragcctggtggctagg

SEQ ID NO: 4966 - DNA, 23 bp, synthetic construct
  source 1..23: mol_type = other DNA
acaaatcrgaagatgtttggagg

SEQ ID NO: 4967 - DNA, 23 bp, synthetic construct
  source 1..23: mol_type = other DNA
cctgatcttctgctgcttcygag

SEQ ID NO: 4968 - DNA, 23 bp, synthetic construct
  source 1..23: mol_type = other DNA
ccgtggggcctggcctcayctgc

SEQ ID NO: 4969 - DNA, 23 bp, synthetic construct
  source 1..23: mol_type = other DNA
tgtcaacargaatgcagcagtgg

SEQ ID NO: 4970 - DNA, 23 bp, synthetic construct
  source 1..23: mol_type = other DNA
tacragctgaaccagcgcgtcgg

SEQ ID NO: 4971 - DNA, 23 bp, synthetic construct
  source 1..23: mol_type = other DNA
tttraaatggatgttcaggtagg

SEQ ID NO: 4972 - DNA, 23 bp, synthetic construct
  source 1..23: mol_type = other DNA
ttactttraaatggatgttcagg

SEQ ID NO: 4973 - DNA, 23 bp, synthetic construct
  source 1..23: mol_type = other DNA
gatrgatacgtggacccttctgg

SEQ ID NO: 4974 - DNA, 23 bp, synthetic construct
  source 1..23: mol_type = other DNA
gatgratacgtggacccttctgg

SEQ ID NO: 4975 - DNA, 23 bp, synthetic construct
  source 1..23: mol_type = other DNA
cagttgraatgtaaaggtgaagg

SEQ ID NO: 4976 - DNA, 23 bp, synthetic construct
  source 1..23: mol_type = other DNA
ccatatcactacgaaygagttgt

SEQ ID NO: 4977 - DNA, 23 bp, synthetic construct
  source 1..23: mol_type = other DNA
tggcctggrcttaaatcttcagg

SEQ ID NO: 4978 - DNA, 23 bp, synthetic construct
  source 1..23: mol_type = other DNA
cctcttgactgggacccygctgc

SEQ ID NO: 4979 - DNA, 23 bp, synthetic construct
  source 1..23: mol_type = other DNA
cagcgactrgaatcctcaccagg

SEQ ID NO: 4980 - DNA, 23 bp, synthetic construct
  source 1..23: mol_type = other DNA
gctcaagrtacatgctggagagg

SEQ ID NO: 4981 - DNA, 23 bp, synthetic construct
  source 1..23: mol_type = other DNA
ccgatgcccgggatgcagyagca

SEQ ID NO: 4982 - DNA, 23 bp, synthetic construct
  source 1..23: mol_type = other DNA
cctgcaagcgcaggacygagccc

SEQ ID NO: 4983 - DNA, 23 bp, synthetic construct
  source 1..23: mol_type = other DNA
gatgaggcrtcttgccaacacgg

SEQ ID NO: 4984 - DNA, 23 bp, synthetic construct
  source 1..23: mol_type = other DNA
ccatgagaacgcatctyagcccg

SEQ ID NO: 4985 - DNA, 23 bp, synthetic construct
  source 1..23: mol_type = other DNA
gagcagccrccagcagcgaaagg

SEQ ID NO: 4986 - DNA, 23 bp, synthetic construct
  source 1..23: mol_type = other DNA
cccatggactgcagatgyggctc

SEQ ID NO: 4987 - DNA, 23 bp, synthetic construct
  source 1..23: mol_type = other DNA
ccatggactgcagatgyggctca

SEQ ID NO: 4988 - DNA, 23 bp, synthetic construct
  source 1..23: mol_type = other DNA
cccttaggtaagtcaaatytcat

SEQ ID NO: 4989 - DNA, 23 bp, synthetic construct
  source 1..23: mol_type = other DNA
ccttaggtaagtcaaatytcatg

SEQ ID NO: 4990 - DNA, 23 bp, synthetic construct
  source 1..23: mol_type = other DNA
gagcgatrattctgacatttggg

SEQ ID NO: 4991 - DNA, 23 bp, synthetic construct
  source 1..23: mol_type = other DNA
agagcgatrattctgacatttgg

SEQ ID NO: 4992 - DNA, 23 bp, synthetic construct
  source 1..23: mol_type = other DNA
ccataagrgccacccaccctcgg

SEQ ID NO: 4993 - DNA, 23 bp, synthetic construct
  source 1..23: mol_type = other DNA
cccacatgrattggtgttgctgg

SEQ ID NO: 4994 - DNA, 23 bp, synthetic construct
  source 1..23: mol_type = other DNA
accaagragggagtggtgcatgg

SEQ ID NO: 4995 - DNA, 23 bp, synthetic construct
  source 1..23: mol_type = other DNA
gagctrtgttctctggggcaggg

SEQ ID NO: 4996 - DNA, 23 bp, synthetic construct
  source 1..23: mol_type = other DNA
ggagctrtgttctctggggcagg

SEQ ID NO: 4997 - DNA, 23 bp, synthetic construct
  source 1..23: mol_type = other DNA
tagcttccrtccagtgcctctgg

SEQ ID NO: 4998 - DNA, 23 bp, synthetic construct
  source 1..23: mol_type = other DNA
cctgaccgtgggccacygagccc

SEQ ID NO: 4999 - DNA, 23 bp, synthetic construct
  source 1..23: mol_type = other DNA
aagrccgtgtgcgtgctgaaggg

SEQ ID NO: 5000 - DNA, 23 bp, synthetic construct
  source 1..23: mol_type = other DNA
gaagrccgtgtgcgtgctgaagg

SEQ ID NO: 5001 - DNA, 23 bp, synthetic construct
  source 1..23: mol_type = other DNA
gtttgrcttgtggtgtaattggg

SEQ ID NO: 5002 - DNA, 23 bp, synthetic construct
  source 1..23: mol_type = other DNA
cgtttgrcttgtggtgtaattgg

SEQ ID NO: 5003 - DNA, 23 bp, synthetic construct
  source 1..23: mol_type = other DNA
ttcragcagaaggcaagggctgg

SEQ ID NO: 5004 - DNA, 23 bp, synthetic construct
  source 1..23: mol_type = other DNA
caatttcragcagaaggcaaggg

SEQ ID NO: 5005 - DNA, 23 bp, synthetic construct
  source 1..23: mol_type = other DNA
tcaatttcragcagaaggcaagg

SEQ ID NO: 5006 - DNA, 23 bp, synthetic construct
  source 1..23: mol_type = other DNA
ggttggragggaaaagacattgg

SEQ ID NO: 5007 - DNA, 23 bp, synthetic construct
  source 1..23: mol_type = other DNA
tttaraagaaagagtagctgtgg

SEQ ID NO: 5008 - DNA, 23 bp, synthetic construct
  source 1..23: mol_type = other DNA
gtgttrtaatgaatttataatgg

SEQ ID NO: 5009 - DNA, 23 bp, synthetic construct
  source 1..23: mol_type = other DNA
gcaagtgrtggcgacctagtggg

SEQ ID NO: 5010 - DNA, 23 bp, synthetic construct
  source 1..23: mol_type = other DNA
ggcaagtgrtggcgacctagtgg

SEQ ID NO: 5011 - DNA, 23 bp, synthetic construct
  source 1..23: mol_type = other DNA
gtgtartggagggccaggggtgg

SEQ ID NO: 5012 - DNA, 23 bp, synthetic construct
  source 1..23: mol_type = other DNA
tccgtgtartggagggccagggg

SEQ ID NO: 5013 - DNA, 23 bp, synthetic construct
  source 1..23: mol_type = other DNA
ccgcggcaagtggtggygaccta

SEQ ID NO: 5014 - DNA, 23 bp, synthetic construct
  source 1..23: mol_type = other DNA
ccgtgtagtggagggcyaggggt

SEQ ID NO: 5015 - DNA, 23 bp, synthetic construct
  source 1..23: mol_type = other DNA
tttgtrtgaaagaagagaagggg

SEQ ID NO: 5016 - DNA, 23 bp, synthetic construct
  source 1..23: mol_type = other DNA
ttttgtrtgaaagaagagaaggg

SEQ ID NO: 5017 - DNA, 23 bp, synthetic construct
  source 1..23: mol_type = other DNA
cttttgtrtgaaagaagagaagg

SEQ ID NO: 5018 - DNA, 23 bp, synthetic construct
  source 1..23: mol_type = other DNA
cagrtgagtgtggtttgctatgg

SEQ ID NO: 5019 - DNA, 23 bp, synthetic construct
  source 1..23: mol_type = other DNA
tatacarcctggcctatggcagg

SEQ ID NO: 5020 - DNA, 23 bp, synthetic construct
  source 1..23: mol_type = other DNA
gtcracagtagttcttcccatgg

SEQ ID NO: 5021 - DNA, 23 bp, synthetic construct
  source 1..23: mol_type = other DNA
cctcaggactcctgtgtgygaca

SEQ ID NO: 5022 - DNA, 23 bp, synthetic construct
  source 1..23: mol_type = other DNA
ccccgccgaggcgatggggyagc

SEQ ID NO: 5023 - DNA, 23 bp, synthetic construct
  source 1..23: mol_type = other DNA
cccgccgaggcgatggggyagct

SEQ ID NO: 5024 - DNA, 23 bp, synthetic construct
  source 1..23: mol_type = other DNA
ccgccgaggcgatggggyagctc

SEQ ID NO: 5025 - DNA, 23 bp, synthetic construct
  source 1..23: mol_type = other DNA
ccgaggcgatggggyagctcggc

SEQ ID NO: 5026 - DNA, 23 bp, synthetic construct
  source 1..23: mol_type = other DNA
cctcartggtggttctggcgggg

SEQ ID NO: 5027 - DNA, 23 bp, synthetic construct
  source 1..23: mol_type = other DNA
tcctcartggtggttctggcggg

SEQ ID NO: 5028 - DNA, 23 bp, synthetic construct
  source 1..23: mol_type = other DNA
gtcctcartggtggttctggcgg

SEQ ID NO: 5029 - DNA, 23 bp, synthetic construct
  source 1..23: mol_type = other DNA
ccctctgtgccctgcaacytttc

SEQ ID NO: 5030 - DNA, 23 bp, synthetic construct
  source 1..23: mol_type = other DNA
cctctgtgccctgcaacytttca

SEQ ID NO: 5031 - DNA, 23 bp, synthetic construct
  source 1..23: mol_type = other DNA
cctgagtgactccactyaagtga

SEQ ID NO: 5032 - DNA, 23 bp, synthetic construct
  source 1..23: mol_type = other DNA
ccagagccgccgtgattyctcca

SEQ ID NO: 5033 - DNA, 23 bp, synthetic construct
  source 1..23: mol_type = other DNA
cggggtrtggtggagtactttgg

SEQ ID NO: 5034 - DNA, 23 bp, synthetic construct
  source 1..23: mol_type = other DNA
cgccagrcaagtgaaccaagagg

SEQ ID NO: 5035 - DNA, 23 bp, synthetic construct
  source 1..23: mol_type = other DNA
ccttgtacccacatctccygcca

SEQ ID NO: 5036 - DNA, 23 bp, synthetic construct
  source 1..23: mol_type = other DNA
ccaccgtgtgctcaggaggygcc

SEQ ID NO: 5037 - DNA, 23 bp, synthetic construct
  source 1..23: mol_type = other DNA
ccgtgtgctcaggaggygccccg

SEQ ID NO: 5038 - DNA, 23 bp, synthetic construct
  source 1..23: mol_type = other DNA
ccaccgagccccagtacyagccc

SEQ ID NO: 5039 - DNA, 23 bp, synthetic construct
  source 1..23: mol_type = other DNA
ccgagccccagtacyagcccggg

SEQ ID NO: 5040 - DNA, 23 bp, synthetic construct
  source 1..23: mol_type = other DNA
ccagcacctaggcctygacccac

SEQ ID NO: 5041 - DNA, 23 bp, synthetic construct
  source 1..23: mol_type = other DNA
ccgagaggagctcaaayaggcag

SEQ ID NO: 5042 - DNA, 23 bp, synthetic construct
  source 1..23: mol_type = other DNA
agagrcactgccttctgcactgg

SEQ ID NO: 5043 - DNA, 23 bp, synthetic construct
  source 1..23: mol_type = other DNA
tcctcrgtgagatcattgaatgg

SEQ ID NO: 5044 - DNA, 23 bp, synthetic construct
  source 1..23: mol_type = other DNA
tcgtgtrgtctcgcgatcagagg

SEQ ID NO: 5045 - DNA, 23 bp, synthetic construct
  source 1..23: mol_type = other DNA
ccaggagrcacagaaattacagg

SEQ ID NO: 5046 - DNA, 23 bp, synthetic construct
  source 1..23: mol_type = other DNA
aaaatrgccattcttccaggagg

SEQ ID NO: 5047 - DNA, 23 bp, synthetic construct
  source 1..23: mol_type = other DNA
cgaaaaatrgccattcttccagg

SEQ ID NO: 5048 - DNA, 23 bp, synthetic construct
  source 1..23: mol_type = other DNA
ccatraacgcattcatcgtgtgg

SEQ ID NO: 5049 - DNA, 23 bp, synthetic construct
  source 1..23: mol_type = other DNA
ccttgtttttgacaatgyaatca

SEQ ID NO: 5050 - DNA, 23 bp, synthetic construct
  source 1..23: mol_type = other DNA
ccttagccattctgggtaygact

SEQ ID NO: 5051 - DNA, 23 bp, synthetic construct
  source 1..23: mol_type = other DNA
cccgccaaactgacttyatcgca

SEQ ID NO: 5052 - DNA, 23 bp, synthetic construct
  source 1..23: mol_type = other DNA
ccgccaaactgacttyatcgcac

SEQ ID NO: 5053 - DNA, 23 bp, synthetic construct
  source 1..23: mol_type = other DNA
ccaggagctagaaaaagagygac

SEQ ID NO: 5054 - DNA, 23 bp, synthetic construct
  source 1..23: mol_type = other DNA
ccatcacagaccttygatgagcg

SEQ ID NO: 5055 - DNA, 23 bp, synthetic construct
  source 1..23: mol_type = other DNA
ccaccccgtcggtacttcygctc

SEQ ID NO: 5056 - DNA, 23 bp, synthetic construct
  source 1..23: mol_type = other DNA
ccccgtcggtacttcygctctgg

SEQ ID NO: 5057 - DNA, 23 bp, synthetic construct
  source 1..23: mol_type = other DNA
cccgtcggtacttcygctctgga

SEQ ID NO: 5058 - DNA, 23 bp, synthetic construct
  source 1..23: mol_type = other DNA
cccaagagcatcatcaacyaggt

SEQ ID NO: 5059 - DNA, 23 bp, synthetic construct
  source 1..23: mol_type = other DNA
ccaagagcatcatcaacyaggtc

SEQ ID NO: 5060 - DNA, 23 bp, synthetic construct
  source 1..23: mol_type = other DNA
ccgtgactttgtgagcgtgygct

SEQ ID NO: 5061 - DNA, 23 bp, synthetic construct
  source 1..23: mol_type = other DNA
cccaggttcactatagttgygga

SEQ ID NO: 5062 - DNA, 23 bp, synthetic construct
  source 1..23: mol_type = other DNA
ccaggttcactatagttgyggag

SEQ ID NO: 5063 - DNA, 23 bp, synthetic construct
  source 1..23: mol_type = other DNA
cagrtcgttctgtaggaaatggg

SEQ ID NO: 5064 - DNA, 23 bp, synthetic construct
  source 1..23: mol_type = other DNA
gcagrtcgttctgtaggaaatgg

SEQ ID NO: 5065 - DNA, 23 bp, synthetic construct
  source 1..23: mol_type = other DNA
cccctgtgattcagatccyggaa

SEQ ID NO: 5066 - DNA, 23 bp, synthetic construct
  source 1..23: mol_type = other DNA
ccctgtgattcagatccyggaaa

SEQ ID NO: 5067 - DNA, 23 bp, synthetic construct
  source 1..23: mol_type = other DNA
cctgtgattcagatccyggaaat

SEQ ID NO: 5068 - DNA, 23 bp, synthetic construct
  source 1..23: mol_type = other DNA
ccagacgtttgaggagctgygac

SEQ ID NO: 5069 - DNA, 23 bp, synthetic construct
  source 1..23: mol_type = other DNA
cctargttcgggaggccttgagg

SEQ ID NO: 5070 - DNA, 23 bp, synthetic construct
  source 1..23: mol_type = other DNA
ccagcggctgaaggagctgyggg

SEQ ID NO: 5071 - DNA, 23 bp, synthetic construct
  source 1..23: mol_type = other DNA
tgcacaagracatcaagccgggg

SEQ ID NO: 5072 - DNA, 23 bp, synthetic construct
  source 1..23: mol_type = other DNA
cctggagtacctgcatagcyagg

SEQ ID NO: 5073 - DNA, 23 bp, synthetic construct
  source 1..23: mol_type = other DNA
ccatccggcagatcyggcagcac

SEQ ID NO: 5074 - DNA, 23 bp, synthetic construct
  source 1..23: mol_type = other DNA
ttccrcaagacggccctgttggg

SEQ ID NO: 5075 - DNA, 23 bp, synthetic construct
  source 1..23: mol_type = other DNA
cttccrcaagacggccctgttgg

SEQ ID NO: 5076 - DNA, 23 bp, synthetic construct
  source 1..23: mol_type = other DNA
ctgrtacatcgatgagccccagg

SEQ ID NO: 5077 - DNA, 23 bp, synthetic construct
  source 1..23: mol_type = other DNA
cccaaccctgcaggtcttcygca

SEQ ID NO: 5078 - DNA, 23 bp, synthetic construct
  source 1..23: mol_type = other DNA
ccaaccctgcaggtcttcygcaa

SEQ ID NO: 5079 - DNA, 23 bp, synthetic construct
  source 1..23: mol_type = other DNA
ccctgcaggtcttcygcaagacg

SEQ ID NO: 5080 - DNA, 23 bp, synthetic construct
  source 1..23: mol_type = other DNA
ccttgcctctgtgctagccytgt

SEQ ID NO: 5081 - DNA, 23 bp, synthetic construct
  source 1..23: mol_type = other DNA
cctctgtgctagccytgtggatt

SEQ ID NO: 5082 - DNA, 23 bp, synthetic construct
  source 1..23: mol_type = other DNA
cctcrtacatctgcacaatttgg

SEQ ID NO: 5083 - DNA, 23 bp, synthetic construct
  source 1..23: mol_type = other DNA
ccctcatctacttcacatyggac

SEQ ID NO: 5084 - DNA, 23 bp, synthetic construct
  source 1..23: mol_type = other DNA
cctcatctacttcacatyggacc

SEQ ID NO: 5085 - DNA, 23 bp, synthetic construct
  source 1..23: mol_type = other DNA
agcagrccctggccgactgccgg

SEQ ID NO: 5086 - DNA, 23 bp, synthetic construct
  source 1..23: mol_type = other DNA
tggacraggacgacgacctgtgg

SEQ ID NO: 5087 - DNA, 23 bp, synthetic construct
  source 1..23: mol_type = other DNA
gctgtgcrgtatcgggggtaagg

SEQ ID NO: 5088 - DNA, 23 bp, synthetic construct
  source 1..23: mol_type = other DNA
cattctargtatgagaccagcgg

SEQ ID NO: 5089 - DNA, 23 bp, synthetic construct
  source 1..23: mol_type = other DNA
gactrtatgaagcattaccaagg

SEQ ID NO: 5090 - DNA, 23 bp, synthetic construct
  source 1..23: mol_type = other DNA
gaccctttrtgccaccctgaagg

SEQ ID NO: 5091 - DNA, 23 bp, synthetic construct
  source 1..23: mol_type = other DNA
ccgtagacaaactctgcygagtg

SEQ ID NO: 5092 - DNA, 23 bp, synthetic construct
  source 1..23: mol_type = other DNA
cctacgaggtgaccyaggccaac

SEQ ID NO: 5093 - DNA, 23 bp, synthetic construct
  source 1..23: mol_type = other DNA
cgggrgcgcggtggggccggggg

SEQ ID NO: 5094 - DNA, 23 bp, synthetic construct
  source 1..23: mol_type = other DNA
ccgggrgcgcggtggggccgggg

SEQ ID NO: 5095 - DNA, 23 bp, synthetic construct
  source 1..23: mol_type = other DNA
gccgggrgcgcggtggggccggg

SEQ ID NO: 5096 - DNA, 23 bp, synthetic construct
  source 1..23: mol_type = other DNA
ggccgggrgcgcggtggggccgg

SEQ ID NO: 5097 - DNA, 23 bp, synthetic construct
  source 1..23: mol_type = other DNA
actrcacttgggcagggaagcgg

SEQ ID NO: 5098 - DNA, 23 bp, synthetic construct
  source 1..23: mol_type = other DNA
cccccttctgggaaagacygagt

SEQ ID NO: 5099 - DNA, 23 bp, synthetic construct
  source 1..23: mol_type = other DNA
ccccttctgggaaagacygagtg

SEQ ID NO: 5100 - DNA, 23 bp, synthetic construct
  source 1..23: mol_type = other DNA
cccttctgggaaagacygagtga

SEQ ID NO: 5101 - DNA, 23 bp, synthetic construct
  source 1..23: mol_type = other DNA
ccttctgggaaagacygagtgaa

SEQ ID NO: 5102 - DNA, 23 bp, synthetic construct
  source 1..23: mol_type = other DNA
gagrtgttctcagcaatgcctgg

SEQ ID NO: 5103 - DNA, 23 bp, synthetic construct
  source 1..23: mol_type = other DNA
cccgcctctccgtctcccyagcg

SEQ ID NO: 5104 - DNA, 23 bp, synthetic construct
  source 1..23: mol_type = other DNA
ccgcctctccgtctcccyagcgc

SEQ ID NO: 5105 - DNA, 23 bp, synthetic construct
  source 1..23: mol_type = other DNA
cctctccgtctcccyagcgccag

SEQ ID NO: 5106 - DNA, 23 bp, synthetic construct
  source 1..23: mol_type = other DNA
ccccccagcgtgttccygaggga

SEQ ID NO: 5107 - DNA, 23 bp, synthetic construct
  source 1..23: mol_type = other DNA
cccccagcgtgttccygagggag

SEQ ID NO: 5108 - DNA, 23 bp, synthetic construct
  source 1..23: mol_type = other DNA
ccccagcgtgttccygagggagc

SEQ ID NO: 5109 - DNA, 23 bp, synthetic construct
  source 1..23: mol_type = other DNA
gtccrgggaacaaatgatgatgg

SEQ ID NO: 5110 - DNA, 23 bp, synthetic construct
  source 1..23: mol_type = other DNA
ccacctgtacttaacagtycaca

SEQ ID NO: 5111 - DNA, 23 bp, synthetic construct
  source 1..23: mol_type = other DNA
cctgtacttaacagtycacaggg

SEQ ID NO: 5112 - DNA, 23 bp, synthetic construct
  source 1..23: mol_type = other DNA
cctgggatttctcctcccyagag

SEQ ID NO: 5113 - DNA, 23 bp, synthetic construct
  source 1..23: mol_type = other DNA
ccgcttcaaggcgcgcyagtgca

SEQ ID NO: 5114 - DNA, 23 bp, synthetic construct
  source 1..23: mol_type = other DNA
ccagatcgagctgcggyagaaca

SEQ ID NO: 5115 - DNA, 23 bp, synthetic construct
  source 1..23: mol_type = other DNA
ccaaggctttgagtctcttygtc

SEQ ID NO: 5116 - DNA, 23 bp, synthetic construct
  source 1..23: mol_type = other DNA
gctrttttgggaaacaatcaagg

SEQ ID NO: 5117 - DNA, 23 bp, synthetic construct
  source 1..23: mol_type = other DNA
atccrctactctttatttcatgg

SEQ ID NO: 5118 - DNA, 23 bp, synthetic construct
  source 1..23: mol_type = other DNA
tcaagtgrggtaagggctgctgg

SEQ ID NO: 5119 - DNA, 23 bp, synthetic construct
  source 1..23: mol_type = other DNA
ccatggggactgggtgyatatct

SEQ ID NO: 5120 - DNA, 23 bp, synthetic construct
  source 1..23: mol_type = other DNA
ttcrtctgatctcatcagtcagg

SEQ ID NO: 5121 - DNA, 23 bp, synthetic construct
  source 1..23: mol_type = other DNA
tgarcaggggccctggagccagg

SEQ ID NO: 5122 - DNA, 23 bp, synthetic construct
  source 1..23: mol_type = other DNA
cctggcctttgagtygtcctgca

SEQ ID NO: 5123 - DNA, 23 bp, synthetic construct
  source 1..23: mol_type = other DNA
aaaggaaragatggaaggggtgg

SEQ ID NO: 5124 - DNA, 23 bp, synthetic construct
  source 1..23: mol_type = other DNA
ccttttaccggtgagyaactact

SEQ ID NO: 5125 - DNA, 23 bp, synthetic construct
  source 1..23: mol_type = other DNA
ccgccgccgccgcggagyaggta

SEQ ID NO: 5126 - DNA, 23 bp, synthetic construct
  source 1..23: mol_type = other DNA
ccgccgccgcggagyaggtaggg

SEQ ID NO: 5127 - DNA, 23 bp, synthetic construct
  source 1..23: mol_type = other DNA
ccctttgccaaaggatttygggg

SEQ ID NO: 5128 - DNA, 23 bp, synthetic construct
  source 1..23: mol_type = other DNA
cctttgccaaaggatttyggggc

SEQ ID NO: 5129 - DNA, 23 bp, synthetic construct
  source 1..23: mol_type = other DNA
attcacacrggaggcagctcagg

SEQ ID NO: 5130 - DNA, 23 bp, synthetic construct
  source 1..23: mol_type = other DNA
ccctggctgatgatgyggatggg

SEQ ID NO: 5131 - DNA, 23 bp, synthetic construct
  source 1..23: mol_type = other DNA
cctggctgatgatgyggatgggc

SEQ ID NO: 5132 - DNA, 23 bp, synthetic construct
  source 1..23: mol_type = other DNA
ccagctgccctaccagygggtac

SEQ ID NO: 5133 - DNA, 23 bp, synthetic construct
  source 1..23: mol_type = other DNA
ttgrtctagaaatggaggacagg

SEQ ID NO: 5134 - DNA, 23 bp, synthetic construct
  source 1..23: mol_type = other DNA
gctgtttgrtctagaaatggagg

SEQ ID NO: 5135 - DNA, 23 bp, synthetic construct
  source 1..23: mol_type = other DNA
cccgagagcgtctgygggtccgt

SEQ ID NO: 5136 - DNA, 23 bp, synthetic construct
  source 1..23: mol_type = other DNA
ccacagcttcctgtcyagtctgc

SEQ ID NO: 5137 - DNA, 23 bp, synthetic construct
  source 1..23: mol_type = other DNA
ccgccargcactttggccagagg

SEQ ID NO: 5138 - DNA, 23 bp, synthetic construct
  source 1..23: mol_type = other DNA
tgttcrgggatgtgggccacggg

SEQ ID NO: 5139 - DNA, 23 bp, synthetic construct
  source 1..23: mol_type = other DNA
atgttcrgggatgtgggccacgg

SEQ ID NO: 5140 - DNA, 23 bp, synthetic construct
  source 1..23: mol_type = other DNA
ccccgaggaaggccygagcctcg

SEQ ID NO: 5141 - DNA, 23 bp, synthetic construct
  source 1..23: mol_type = other DNA
cagctcgrttttgagagggaggg

SEQ ID NO: 5142 - DNA, 23 bp, synthetic construct
  source 1..23: mol_type = other DNA
ccagctcgrttttgagagggagg

SEQ ID NO: 5143 - DNA, 23 bp, synthetic construct
  source 1..23: mol_type = other DNA
ccatatctaagtgcaagytcttc

SEQ ID NO: 5144 - DNA, 23 bp, synthetic construct
  source 1..23: mol_type = other DNA
ccttcrcaagagccgtgtgctgg

SEQ ID NO: 5145 - DNA, 23 bp, synthetic construct
  source 1..23: mol_type = other DNA
catrcagttcgctttcctgttgg

SEQ ID NO: 5146 - DNA, 23 bp, synthetic construct
  source 1..23: mol_type = other DNA
gtcagccrcgggtctctcggggg

SEQ ID NO: 5147 - DNA, 23 bp, synthetic construct
  source 1..23: mol_type = other DNA
tgtcagccrcgggtctctcgggg

SEQ ID NO: 5148 - DNA, 23 bp, synthetic construct
  source 1..23: mol_type = other DNA
cctgggaggggtggtggycattt

SEQ ID NO: 5149 - DNA, 23 bp, synthetic construct
  source 1..23: mol_type = other DNA
ccgcrtgggcgacgacgtgctgg

SEQ ID NO: 5150 - DNA, 23 bp, synthetic construct
  source 1..23: mol_type = other DNA
cctccrtgagcctgtcctggggg

SEQ ID NO: 5151 - DNA, 23 bp, synthetic construct
  source 1..23: mol_type = other DNA
acctccrtgagcctgtcctgggg

SEQ ID NO: 5152 - DNA, 23 bp, synthetic construct
  source 1..23: mol_type = other DNA
gacctccrtgagcctgtcctggg

SEQ ID NO: 5153 - DNA, 23 bp, synthetic construct
  source 1..23: mol_type = other DNA
tgacctccrtgagcctgtcctgg

SEQ ID NO: 5154 - DNA, 23 bp, synthetic construct
  source 1..23: mol_type = other DNA
caccttcrtgctgcgtgtgcggg

SEQ ID NO: 5155 - DNA, 23 bp, synthetic construct
  source 1..23: mol_type = other DNA
gcaccttcrtgctgcgtgtgcgg

SEQ ID NO: 5156 - DNA, 23 bp, synthetic construct
  source 1..23: mol_type = other DNA
tcacctacrtgccactcctgggg

SEQ ID NO: 5157 - DNA, 23 bp, synthetic construct
  source 1..23: mol_type = other DNA
gctgcrgccgattgtgaacatgg

SEQ ID NO: 5158 - DNA, 23 bp, synthetic construct
  source 1..23: mol_type = other DNA
tggrcctggacgatatccacagg

SEQ ID NO: 5159 - DNA, 23 bp, synthetic construct
  source 1..23: mol_type = other DNA
cagrtgggcctccccggggtcgg

SEQ ID NO: 5160 - DNA, 23 bp, synthetic construct
  source 1..23: mol_type = other DNA
ccgccagrtgggcctccccgggg

SEQ ID NO: 5161 - DNA, 23 bp, synthetic construct
  source 1..23: mol_type = other DNA
tccgccagrtgggcctccccggg

SEQ ID NO: 5162 - DNA, 23 bp, synthetic construct
  source 1..23: mol_type = other DNA
ccaggcacaacgaacgcygcttc

SEQ ID NO: 5163 - DNA, 23 bp, synthetic construct
  source 1..23: mol_type = other DNA
cccaggacccgccgyctgagctg

SEQ ID NO: 5164 - DNA, 23 bp, synthetic construct
  source 1..23: mol_type = other DNA
cctcttcgacgtcttcctaygct

SEQ ID NO: 5165 - DNA, 23 bp, synthetic construct
  source 1..23: mol_type = other DNA
cccagacctgctcgatgaygacg

SEQ ID NO: 5166 - DNA, 23 bp, synthetic construct
  source 1..23: mol_type = other DNA
ccagacctgctcgatgaygacgg

SEQ ID NO: 5167 - DNA, 23 bp, synthetic construct
  source 1..23: mol_type = other DNA
gcgrcaaggaggacttgatctgg

SEQ ID NO: 5168 - DNA, 23 bp, synthetic construct
  source 1..23: mol_type = other DNA
cgaagcgratgctgtgacactgg

SEQ ID NO: 5169 - DNA, 23 bp, synthetic construct
  source 1..23: mol_type = other DNA
accrtctaccagcgtgtggaagg

SEQ ID NO: 5170 - DNA, 23 bp, synthetic construct
  source 1..23: mol_type = other DNA
tcagaccrtctaccagcgtgtgg

SEQ ID NO: 5171 - DNA, 23 bp, synthetic construct
  source 1..23: mol_type = other DNA
ccaagcctgtccagccagyaggc

SEQ ID NO: 5172 - DNA, 23 bp, synthetic construct
  source 1..23: mol_type = other DNA
cctgggccccgggccaygactgc

SEQ ID NO: 5173 - DNA, 23 bp, synthetic construct
  source 1..23: mol_type = other DNA
agctaccragtgggtgtcttcgg

SEQ ID NO: 5174 - DNA, 23 bp, synthetic construct
  source 1..23: mol_type = other DNA
ccagaatggccagtatygagcca

SEQ ID NO: 5175 - DNA, 23 bp, synthetic construct
  source 1..23: mol_type = other DNA
agagaacrgagcagactcttggg

SEQ ID NO: 5176 - DNA, 23 bp, synthetic construct
  source 1..23: mol_type = other DNA
aagagaacrgagcagactcttgg

SEQ ID NO: 5177 - DNA, 23 bp, synthetic construct
  source 1..23: mol_type = other DNA
ccctgccaccaagagaayggagc

SEQ ID NO: 5178 - DNA, 23 bp, synthetic construct
  source 1..23: mol_type = other DNA
cctgccaccaagagaayggagca

SEQ ID NO: 5179 - DNA, 23 bp, synthetic construct
  source 1..23: mol_type = other DNA
ccattgcttgttcagagaayaat

SEQ ID NO: 5180 - DNA, 23 bp, synthetic construct
  source 1..23: mol_type = other DNA
cctctagagaagaacgttygtgg

SEQ ID NO: 5181 - DNA, 23 bp, synthetic construct
  source 1..23: mol_type = other DNA
tctcrctgtaatgcagtgggagg

SEQ ID NO: 5182 - DNA, 23 bp, synthetic construct
  source 1..23: mol_type = other DNA
acatctcrctgtaatgcagtggg

SEQ ID NO: 5183 - DNA, 23 bp, synthetic construct
  source 1..23: mol_type = other DNA
gacatctcrctgtaatgcagtgg

SEQ ID NO: 5184 - DNA, 23 bp, synthetic construct
  source 1..23: mol_type = other DNA
cccagtgtgtggcagaaygcttc

SEQ ID NO: 5185 - DNA, 23 bp, synthetic construct
  source 1..23: mol_type = other DNA
ccagtgtgtggcagaaygcttca

SEQ ID NO: 5186 - DNA, 23 bp, synthetic construct
  source 1..23: mol_type = other DNA
ccacgacccagaggccygtctca

SEQ ID NO: 5187 - DNA, 23 bp, synthetic construct
  source 1..23: mol_type = other DNA
tatrtggaggagaaggccatcgg

SEQ ID NO: 5188 - DNA, 23 bp, synthetic construct
  source 1..23: mol_type = other DNA
ctcccrggtcatctctgccatgg

SEQ ID NO: 5189 - DNA, 23 bp, synthetic construct
  source 1..23: mol_type = other DNA
ggcrtgaccaccacaggtagtgg

SEQ ID NO: 5190 - DNA, 23 bp, synthetic construct
  source 1..23: mol_type = other DNA
tacrggaccgaagcacagattgg

SEQ ID NO: 5191 - DNA, 23 bp, synthetic construct
  source 1..23: mol_type = other DNA
ggtgagcrgacctggaactacgg

SEQ ID NO: 5192 - DNA, 23 bp, synthetic construct
  source 1..23: mol_type = other DNA
ccagtcgtttgtgcctgtgygac

SEQ ID NO: 5193 - DNA, 23 bp, synthetic construct
  source 1..23: mol_type = other DNA
cccagtgctgtcattggcygcta

SEQ ID NO: 5194 - DNA, 23 bp, synthetic construct
  source 1..23: mol_type = other DNA
ccagtgctgtcattggcygctac

SEQ ID NO: 5195 - DNA, 23 bp, synthetic construct
  source 1..23: mol_type = other DNA
ccccttgcagagcgcaygggctt

SEQ ID NO: 5196 - DNA, 23 bp, synthetic construct
  source 1..23: mol_type = other DNA
cccttgcagagcgcaygggcttc

SEQ ID NO: 5197 - DNA, 23 bp, synthetic construct
  source 1..23: mol_type = other DNA
ccttgcagagcgcaygggcttcc

SEQ ID NO: 5198 - DNA, 23 bp, synthetic construct
  source 1..23: mol_type = other DNA
ccaacrcccaaggcagccactgg

SEQ ID NO: 5199 - DNA, 23 bp, synthetic construct
  source 1..23: mol_type = other DNA
cagccrcttcctgcacatgaagg

SEQ ID NO: 5200 - DNA, 23 bp, synthetic construct
  source 1..23: mol_type = other DNA
cccttcgcgctgctgtgygctat

SEQ ID NO: 5201 - DNA, 23 bp, synthetic construct
  source 1..23: mol_type = other DNA
ccttcgcgctgctgtgygctatg

SEQ ID NO: 5202 - DNA, 23 bp, synthetic construct
  source 1..23: mol_type = other DNA
ccactggaagcaaaaayggaaat

SEQ ID NO: 5203 - DNA, 23 bp, synthetic construct
  source 1..23: mol_type = other DNA
ccagttcatcttgaatygactgg

SEQ ID NO: 5204 - DNA, 23 bp, synthetic construct
  source 1..23: mol_type = other DNA
ccagcagctggtgcacyagatga

SEQ ID NO: 5205 - DNA, 23 bp, synthetic construct
  source 1..23: mol_type = other DNA
cccctgccaaaagccaagyctgg

SEQ ID NO: 5206 - DNA, 23 bp, synthetic construct
  source 1..23: mol_type = other DNA
ccctgccaaaagccaagyctggc

SEQ ID NO: 5207 - DNA, 23 bp, synthetic construct
  source 1..23: mol_type = other DNA
cctgccaaaagccaagyctggca

SEQ ID NO: 5208 - DNA, 23 bp, synthetic construct
  source 1..23: mol_type = other DNA
ccgacgaagagttcagtccyaat

SEQ ID NO: 5209 - DNA, 23 bp, synthetic construct
  source 1..23: mol_type = other DNA
agargttaaagaagagatgcagg

SEQ ID NO: 5210 - DNA, 23 bp, synthetic construct
  source 1..23: mol_type = other DNA
ccaagtggagaaatgtcygtggc

SEQ ID NO: 5211 - DNA, 23 bp, synthetic construct
  source 1..23: mol_type = other DNA
cctttaggtgtcatctgtayggt

SEQ ID NO: 5212 - DNA, 23 bp, synthetic construct
  source 1..23: mol_type = other DNA
cctctcgctggggtcttaygcta

SEQ ID NO: 5213 - DNA, 23 bp, synthetic construct
  source 1..23: mol_type = other DNA
cctccataggccgcagcygaggt

SEQ ID NO: 5214 - DNA, 23 bp, synthetic construct
  source 1..23: mol_type = other DNA
ccataggccgcagcygaggtgcc

SEQ ID NO: 5215 - DNA, 23 bp, synthetic construct
  source 1..23: mol_type = other DNA
actargtaaggaccagagcaagg

SEQ ID NO: 5216 - DNA, 23 bp, synthetic construct
  source 1..23: mol_type = other DNA
cctccccacagcagyagtgttgt

SEQ ID NO: 5217 - DNA, 23 bp, synthetic construct
  source 1..23: mol_type = other DNA
aaccrcctgaccgtgctggctgg

SEQ ID NO: 5218 - DNA, 23 bp, synthetic construct
  source 1..23: mol_type = other DNA
ctataaccrcctgaccgtgctgg

SEQ ID NO: 5219 - DNA, 23 bp, synthetic construct
  source 1..23: mol_type = other DNA
ccagcccatgggccaygttgaaa

SEQ ID NO: 5220 - DNA, 23 bp, synthetic construct
  source 1..23: mol_type = other DNA
ccgccacagcgtcctccaygagc

SEQ ID NO: 5221 - DNA, 23 bp, synthetic construct
  source 1..23: mol_type = other DNA
ccacagcgtcctccaygagctct

SEQ ID NO: 5222 - DNA, 23 bp, synthetic construct
  source 1..23: mol_type = other DNA
ccgagaactactttgtgayggac

SEQ ID NO: 5223 - DNA, 23 bp, synthetic construct
  source 1..23: mol_type = other DNA
cctgcactgcgccgtgygcgcct

SEQ ID NO: 5224 - DNA, 23 bp, synthetic construct
  source 1..23: mol_type = other DNA
ccttctgtgtggccacctygctg

SEQ ID NO: 5225 - DNA, 23 bp, synthetic construct
  source 1..23: mol_type = other DNA
cagratggaagaggcgcattggg

SEQ ID NO: 5226 - DNA, 23 bp, synthetic construct
  source 1..23: mol_type = other DNA
gcagratggaagaggcgcattgg

SEQ ID NO: 5227 - DNA, 23 bp, synthetic construct
  source 1..23: mol_type = other DNA
ccttctctttccctttcyagcag

SEQ ID NO: 5228 - DNA, 23 bp, synthetic construct
  source 1..23: mol_type = other DNA
ccggaaggagatcgaagccyggt

SEQ ID NO: 5229 - DNA, 23 bp, synthetic construct
  source 1..23: mol_type = other DNA
cctcaaacagtccctygattaat

SEQ ID NO: 5230 - DNA, 23 bp, synthetic construct
  source 1..23: mol_type = other DNA
ccggccagcttcataagggygat

SEQ ID NO: 5231 - DNA, 23 bp, synthetic construct
  source 1..23: mol_type = other DNA
ccagcttcataagggygatgtca

SEQ ID NO: 5232 - DNA, 23 bp, synthetic construct
  source 1..23: mol_type = other DNA
ccacccacccggactggcygatg

SEQ ID NO: 5233 - DNA, 23 bp, synthetic construct
  source 1..23: mol_type = other DNA
cccacccggactggcygatgtgc

SEQ ID NO: 5234 - DNA, 23 bp, synthetic construct
  source 1..23: mol_type = other DNA
ccacccggactggcygatgtgca

SEQ ID NO: 5235 - DNA, 23 bp, synthetic construct
  source 1..23: mol_type = other DNA
cctcaccrggcccggtgtgcggg

SEQ ID NO: 5236 - DNA, 23 bp, synthetic construct
  source 1..23: mol_type = other DNA
ccctcaccrggcccggtgtgcgg

SEQ ID NO: 5237 - DNA, 23 bp, synthetic construct
  source 1..23: mol_type = other DNA
cagcracgaagagcagtgccagg

SEQ ID NO: 5238 - DNA, 23 bp, synthetic construct
  source 1..23: mol_type = other DNA
gacraagagcagtgccaggaagg

SEQ ID NO: 5239 - DNA, 23 bp, synthetic construct
  source 1..23: mol_type = other DNA
cagcgacraagagcagtgccagg

SEQ ID NO: 5240 - DNA, 23 bp, synthetic construct
  source 1..23: mol_type = other DNA
cctccaggttcggggtygacaca

SEQ ID NO: 5241 - DNA, 23 bp, synthetic construct
  source 1..23: mol_type = other DNA
ccagtggctgaaccgcygggcca

SEQ ID NO: 5242 - DNA, 23 bp, synthetic construct
  source 1..23: mol_type = other DNA
ctcttcttrcacagtggaccggg

SEQ ID NO: 5243 - DNA, 23 bp, synthetic construct
  source 1..23: mol_type = other DNA
accaagtrccacaaaggtagggg

SEQ ID NO: 5244 - DNA, 23 bp, synthetic construct
  source 1..23: mol_type = other DNA
taccaagtrccacaaaggtaggg

SEQ ID NO: 5245 - DNA, 23 bp, synthetic construct
  source 1..23: mol_type = other DNA
cggacrgcacaccgtgttctggg

SEQ ID NO: 5246 - DNA, 23 bp, synthetic construct
  source 1..23: mol_type = other DNA
acggacrgcacaccgtgttctgg

SEQ ID NO: 5247 - DNA, 23 bp, synthetic construct
  source 1..23: mol_type = other DNA
ccacaggagcgggacctgygaga

SEQ ID NO: 5248 - DNA, 23 bp, synthetic construct
  source 1..23: mol_type = other DNA
cctgcrggcccacctcaagcagg

SEQ ID NO: 5249 - DNA, 23 bp, synthetic construct
  source 1..23: mol_type = other DNA
gacaccragaaggtgagtgtggg

SEQ ID NO: 5250 - DNA, 23 bp, synthetic construct
  source 1..23: mol_type = other DNA
ggacaccragaaggtgagtgtgg

SEQ ID NO: 5251 - DNA, 23 bp, synthetic construct
  source 1..23: mol_type = other DNA
aaaaccrggaggtgggagactgg

SEQ ID NO: 5252 - DNA, 23 bp, synthetic construct
  source 1..23: mol_type = other DNA
cctgcggrcccacctcaagcagg

SEQ ID NO: 5253 - DNA, 23 bp, synthetic construct
  source 1..23: mol_type = other DNA
accttcraggcaagtttaagcgg

SEQ ID NO: 5254 - DNA, 23 bp, synthetic construct
  source 1..23: mol_type = other DNA
cccgggctaaggagtycctggac

SEQ ID NO: 5255 - DNA, 23 bp, synthetic construct
  source 1..23: mol_type = other DNA
ccgggctaaggagtycctggacc

SEQ ID NO: 5256 - DNA, 23 bp, synthetic construct
  source 1..23: mol_type = other DNA
ccagccccaatcagaygccgctc

SEQ ID NO: 5257 - DNA, 23 bp, synthetic construct
  source 1..23: mol_type = other DNA
cgggcgctrgaaatagagcctgg

SEQ ID NO: 5258 - DNA, 23 bp, synthetic construct
  source 1..23: mol_type = other DNA
ccaccrgaagcgcatggagaagg

SEQ ID NO: 5259 - DNA, 23 bp, synthetic construct
  source 1..23: mol_type = other DNA
gacragaggaggaggagaacagg

SEQ ID NO: 5260 - DNA, 23 bp, synthetic construct
  source 1..23: mol_type = other DNA
catccrgaatgagcgggagaagg

SEQ ID NO: 5261 - DNA, 23 bp, synthetic construct
  source 1..23: mol_type = other DNA
cccctgcagctccaagaccygcg

SEQ ID NO: 5262 - DNA, 23 bp, synthetic construct
  source 1..23: mol_type = other DNA
ccctgcagctccaagaccygcgg

SEQ ID NO: 5263 - DNA, 23 bp, synthetic construct
  source 1..23: mol_type = other DNA
cctgcagctccaagaccygcggg

SEQ ID NO: 5264 - DNA, 23 bp, synthetic construct
  source 1..23: mol_type = other DNA
ccacccacaggacatccacygga

SEQ ID NO: 5265 - DNA, 23 bp, synthetic construct
  source 1..23: mol_type = other DNA
cccacaggacatccacyggaagc

SEQ ID NO: 5266 - DNA, 23 bp, synthetic construct
  source 1..23: mol_type = other DNA
ccacaggacatccacyggaagcg

SEQ ID NO: 5267 - DNA, 23 bp, synthetic construct
  source 1..23: mol_type = other DNA
cctgaatgagttgcaggygctga

SEQ ID NO: 5268 - DNA, 23 bp, synthetic construct
  source 1..23: mol_type = other DNA
ccttaggagagacgtygggcaga

SEQ ID NO: 5269 - DNA, 23 bp, synthetic construct
  source 1..23: mol_type = other DNA
catgcggcrctggaacacctggg

SEQ ID NO: 5270 - DNA, 23 bp, synthetic construct
  source 1..23: mol_type = other DNA
cctgccacgaagccygtagaggt

SEQ ID NO: 5271 - DNA, 23 bp, synthetic construct
  source 1..23: mol_type = other DNA
acactgraagactccaggtcagg

SEQ ID NO: 5272 - DNA, 23 bp, synthetic construct
  source 1..23: mol_type = other DNA
cacttttcracatagtgtggtgg

SEQ ID NO: 5273 - DNA, 23 bp, synthetic construct
  source 1..23: mol_type = other DNA
gacctrccctgtgcagctgtggg

SEQ ID NO: 5274 - DNA, 23 bp, synthetic construct
  source 1..23: mol_type = other DNA
agacctrccctgtgcagctgtgg

SEQ ID NO: 5275 - DNA, 23 bp, synthetic construct
  source 1..23: mol_type = other DNA
cccccagggagcactaagygagg

SEQ ID NO: 5276 - DNA, 23 bp, synthetic construct
  source 1..23: mol_type = other DNA
ccccagggagcactaagygaggt

SEQ ID NO: 5277 - DNA, 23 bp, synthetic construct
  source 1..23: mol_type = other DNA
cccagggagcactaagygaggta

SEQ ID NO: 5278 - DNA, 23 bp, synthetic construct
  source 1..23: mol_type = other DNA
ccagggagcactaagygaggtaa

SEQ ID NO: 5279 - DNA, 23 bp, synthetic construct
  source 1..23: mol_type = other DNA
ccctcctcagcatcttatcygag

SEQ ID NO: 5280 - DNA, 23 bp, synthetic construct
  source 1..23: mol_type = other DNA
cctcctcagcatcttatcygagt

SEQ ID NO: 5281 - DNA, 23 bp, synthetic construct
  source 1..23: mol_type = other DNA
cctcagcatcttatcygagtgga

SEQ ID NO: 5282 - DNA, 23 bp, synthetic construct
  source 1..23: mol_type = other DNA
cccctcctcagcatyttatccga

SEQ ID NO: 5283 - DNA, 23 bp, synthetic construct
  source 1..23: mol_type = other DNA
ccatggccatctacaagyagtca

SEQ ID NO: 5284 - DNA, 23 bp, synthetic construct
  source 1..23: mol_type = other DNA
gcccrgatctgtgcttgcccagg

SEQ ID NO: 5285 - DNA, 23 bp, synthetic construct
  source 1..23: mol_type = other DNA
gccracgctgctttgaggcccgg

SEQ ID NO: 5286 - DNA, 23 bp, synthetic construct
  source 1..23: mol_type = other DNA
cctgggccracgctgctttgagg

SEQ ID NO: 5287 - DNA, 23 bp, synthetic construct
  source 1..23: mol_type = other DNA
ctcrgagtaatcgcctgcattgg

SEQ ID NO: 5288 - DNA, 23 bp, synthetic construct
  source 1..23: mol_type = other DNA
gagcracctggaacgtgcagagg

SEQ ID NO: 5289 - DNA, 23 bp, synthetic construct
  source 1..23: mol_type = other DNA
ggatcgarctgagcaggcggagg

SEQ ID NO: 5290 - DNA, 23 bp, synthetic construct
  source 1..23: mol_type = other DNA
cctttccracaagctgaaggagg

SEQ ID NO: 5291 - DNA, 23 bp, synthetic construct
  source 1..23: mol_type = other DNA
tgctragtttgctgagagatcgg

SEQ ID NO: 5292 - DNA, 23 bp, synthetic construct
  source 1..23: mol_type = other DNA
ccactgctcatgatggaggycat

SEQ ID NO: 5293 - DNA, 23 bp, synthetic construct
  source 1..23: mol_type = other DNA
tacrgtgccttttgggactgagg

SEQ ID NO: 5294 - DNA, 23 bp, synthetic construct
  source 1..23: mol_type = other DNA
gccgggtrttggtctgtctctgg

SEQ ID NO: 5295 - DNA, 23 bp, synthetic construct
  source 1..23: mol_type = other DNA
tggccrtgcctacccagatgtgg

SEQ ID NO: 5296 - DNA, 23 bp, synthetic construct
  source 1..23: mol_type = other DNA
cccctctgtgatccgtaagygat

SEQ ID NO: 5297 - DNA, 23 bp, synthetic construct
  source 1..23: mol_type = other DNA
ccctctgtgatccgtaagygata

SEQ ID NO: 5298 - DNA, 23 bp, synthetic construct
  source 1..23: mol_type = other DNA
cctctgtgatccgtaagygatac

SEQ ID NO: 5299 - DNA, 23 bp, synthetic construct
  source 1..23: mol_type = other DNA
ccccctctgtgatcygtaagcga

SEQ ID NO: 5300 - DNA, 23 bp, synthetic construct
  source 1..23: mol_type = other DNA
actgrgggaggcgcaaggcctgg

SEQ ID NO: 5301 - DNA, 23 bp, synthetic construct
  source 1..23: mol_type = other DNA
tttttcracatggaggccactgg

SEQ ID NO: 5302 - DNA, 23 bp, synthetic construct
  source 1..23: mol_type = other DNA
ccaaacacagcttcagccaygag

SEQ ID NO: 5303 - DNA, 23 bp, synthetic construct
  source 1..23: mol_type = other DNA
ccccagaacatcctgtgccyagc

SEQ ID NO: 5304 - DNA, 23 bp, synthetic construct
  source 1..23: mol_type = other DNA
cccagaacatcctgtgccyagcg

SEQ ID NO: 5305 - DNA, 23 bp, synthetic construct
  source 1..23: mol_type = other DNA
ccagaacatcctgtgccyagcgg

SEQ ID NO: 5306 - DNA, 23 bp, synthetic construct
  source 1..23: mol_type = other DNA
cctcatccacccaayaggaaatc

SEQ ID NO: 5307 - DNA, 23 bp, synthetic construct
  source 1..23: mol_type = other DNA
cctgtgtgtattgggtacygaga

SEQ ID NO: 5308 - DNA, 23 bp, synthetic construct
  source 1..23: mol_type = other DNA
cccaatagagccacaygagacaa

SEQ ID NO: 5309 - DNA, 23 bp, synthetic construct
  source 1..23: mol_type = other DNA
ccaatagagccacaygagacaac

SEQ ID NO: 5310 - DNA, 23 bp, synthetic construct
  source 1..23: mol_type = other DNA
taggtgrcctgagagagccctgg

SEQ ID NO: 5311 - DNA, 23 bp, synthetic construct
  source 1..23: mol_type = other DNA
tttcrggccagtttccaagaggg

SEQ ID NO: 5312 - DNA, 23 bp, synthetic construct
  source 1..23: mol_type = other DNA
gtttcrggccagtttccaagagg

SEQ ID NO: 5313 - DNA, 23 bp, synthetic construct
  source 1..23: mol_type = other DNA
tggacrccctgctgaatgaccgg

SEQ ID NO: 5314 - DNA, 23 bp, synthetic construct
  source 1..23: mol_type = other DNA
gagaagragcaggtgagcgccgg

SEQ ID NO: 5315 - DNA, 23 bp, synthetic construct
  source 1..23: mol_type = other DNA
cccaagcttgtgatctyagtcca

SEQ ID NO: 5316 - DNA, 23 bp, synthetic construct
  source 1..23: mol_type = other DNA
ccaagcttgtgatctyagtccat

SEQ ID NO: 5317 - DNA, 23 bp, synthetic construct
  source 1..23: mol_type = other DNA
aagaaagcrccttaacccagagg

SEQ ID NO: 5318 - DNA, 23 bp, synthetic construct
  source 1..23: mol_type = other DNA
tggcraaagaatgcaaatggcgg

SEQ ID NO: 5319 - DNA, 23 bp, synthetic construct
  source 1..23: mol_type = other DNA
ctctggcraaagaatgcaaatgg

SEQ ID NO: 5320 - DNA, 23 bp, synthetic construct
  source 1..23: mol_type = other DNA
ccgcccatctggcgygacctatt

SEQ ID NO: 5321 - DNA, 23 bp, synthetic construct
  source 1..23: mol_type = other DNA
ttcraggtgagccacccagatgg

SEQ ID NO: 5322 - DNA, 23 bp, synthetic construct
  source 1..23: mol_type = other DNA
cccrtgggctgaagctgacgggg

SEQ ID NO: 5323 - DNA, 23 bp, synthetic construct
  source 1..23: mol_type = other DNA
acccrtgggctgaagctgacggg

SEQ ID NO: 5324 - DNA, 23 bp, synthetic construct
  source 1..23: mol_type = other DNA
cacccrtgggctgaagctgacgg

SEQ ID NO: 5325 - DNA, 23 bp, synthetic construct
  source 1..23: mol_type = other DNA
atgcggcrccaggactcgcgagg

SEQ ID NO: 5326 - DNA, 23 bp, synthetic construct
  source 1..23: mol_type = other DNA
ccacaagaaggcggacatgyggc

SEQ ID NO: 5327 - DNA, 23 bp, synthetic construct
  source 1..23: mol_type = other DNA
ccccgcagtgggccaccaycatc

SEQ ID NO: 5328 - DNA, 23 bp, synthetic construct
  source 1..23: mol_type = other DNA
cccgcagtgggccaccaycatcc

SEQ ID NO: 5329 - DNA, 23 bp, synthetic construct
  source 1..23: mol_type = other DNA
ccgcagtgggccaccaycatcct

SEQ ID NO: 5330 - DNA, 23 bp, synthetic construct
  source 1..23: mol_type = other DNA
tcatrgtgcctgaagaaaccagg

SEQ ID NO: 5331 - DNA, 23 bp, synthetic construct
  source 1..23: mol_type = other DNA
ccaatgatggagcatgtgygaat

SEQ ID NO: 5332 - DNA, 23 bp, synthetic construct
  source 1..23: mol_type = other DNA
gcatccrgctgcaggtatggtgg

SEQ ID NO: 5333 - DNA, 23 bp, synthetic construct
  source 1..23: mol_type = other DNA
cggctrgattcagaacctgcagg

SEQ ID NO: 5334 - DNA, 23 bp, synthetic construct
  source 1..23: mol_type = other DNA
gctggccrggctcgtgttccagg

SEQ ID NO: 5335 - DNA, 23 bp, synthetic construct
  source 1..23: mol_type = other DNA
acagrtgagtgtggtgggtgggg

SEQ ID NO: 5336 - DNA, 23 bp, synthetic construct
  source 1..23: mol_type = other DNA
gacagrtgagtgtggtgggtggg

SEQ ID NO: 5337 - DNA, 23 bp, synthetic construct
  source 1..23: mol_type = other DNA
ggacagrtgagtgtggtgggtgg

SEQ ID NO: 5338 - DNA, 23 bp, synthetic construct
  source 1..23: mol_type = other DNA
ccacgtgatcgtcacccygctgg

SEQ ID NO: 5339 - DNA, 23 bp, synthetic construct
  source 1..23: mol_type = other DNA
cccagtggcctccggcccygagg

SEQ ID NO: 5340 - DNA, 23 bp, synthetic construct
  source 1..23: mol_type = other DNA
ccagtggcctccggcccygaggt

SEQ ID NO: 5341 - DNA, 23 bp, synthetic construct
  source 1..23: mol_type = other DNA
cccagaggagaaacccyaggagt

SEQ ID NO: 5342 - DNA, 23 bp, synthetic construct
  source 1..23: mol_type = other DNA
ccagaggagaaacccyaggagtc

SEQ ID NO: 5343 - DNA, 23 bp, synthetic construct
  source 1..23: mol_type = other DNA
tgaatrtggagaaggtgaagagg

SEQ ID NO: 5344 - DNA, 23 bp, synthetic construct
  source 1..23: mol_type = other DNA
tgctrgatattgtatgacacggg

SEQ ID NO: 5345 - DNA, 23 bp, synthetic construct
  source 1..23: mol_type = other DNA
gtgctrgatattgtatgacacgg

SEQ ID NO: 5346 - DNA, 23 bp, synthetic construct
  source 1..23: mol_type = other DNA
cccaaatatgctctgtccyagga

SEQ ID NO: 5347 - DNA, 23 bp, synthetic construct
  source 1..23: mol_type = other DNA
ccaaatatgctctgtccyaggat

SEQ ID NO: 5348 - DNA, 23 bp, synthetic construct
  source 1..23: mol_type = other DNA
cctctgtagacctctacaytcac

SEQ ID NO: 5349 - DNA, 23 bp, synthetic construct
  source 1..23: mol_type = other DNA
ccttggagggggcatgaagyagg

SEQ ID NO: 5350 - DNA, 23 bp, synthetic construct
  source 1..23: mol_type = other DNA
ccccacacagggctcagyagctg

SEQ ID NO: 5351 - DNA, 23 bp, synthetic construct
  source 1..23: mol_type = other DNA
cccacacagggctcagyagctgg

SEQ ID NO: 5352 - DNA, 23 bp, synthetic construct
  source 1..23: mol_type = other DNA
ccacacagggctcagyagctggc

SEQ ID NO: 5353 - DNA, 23 bp, synthetic construct
  source 1..23: mol_type = other DNA
ctgccragccagctgtgctttgg

SEQ ID NO: 5354 - DNA, 23 bp, synthetic construct
  source 1..23: mol_type = other DNA
gctcrctcaatgattttggcagg

SEQ ID NO: 5355 - DNA, 23 bp, synthetic construct
  source 1..23: mol_type = other DNA
ttctgctcrctcaatgattttgg

SEQ ID NO: 5356 - DNA, 23 bp, synthetic construct
  source 1..23: mol_type = other DNA
atccragcttattgtacaggagg

SEQ ID NO: 5357 - DNA, 23 bp, synthetic construct
  source 1..23: mol_type = other DNA
cacatccragcttattgtacagg

SEQ ID NO: 5358 - DNA, 23 bp, synthetic construct
  source 1..23: mol_type = other DNA
ggctgtcrtcaccaatcccaagg

SEQ ID NO: 5359 - DNA, 23 bp, synthetic construct
  source 1..23: mol_type = other DNA
actraggaggaatttgtagaagg

SEQ ID NO: 5360 - DNA, 23 bp, synthetic construct
  source 1..23: mol_type = other DNA
cccaacrtaccagtgaacaaagg

SEQ ID NO: 5361 - DNA, 23 bp, synthetic construct
  source 1..23: mol_type = other DNA
cctggtgccctatcccygcatcc

SEQ ID NO: 5362 - DNA, 23 bp, synthetic construct
  source 1..23: mol_type = other DNA
gtgcactrgtatgtgggtgaggg

SEQ ID NO: 5363 - DNA, 23 bp, synthetic construct
  source 1..23: mol_type = other DNA
tgtgcactrgtatgtgggtgagg

SEQ ID NO: 5364 - DNA, 23 bp, synthetic construct
  source 1..23: mol_type = other DNA
cccaggcctcggcgatggyggtc

SEQ ID NO: 5365 - DNA, 23 bp, synthetic construct
  source 1..23: mol_type = other DNA
ccaggcctcggcgatggyggtcg

SEQ ID NO: 5366 - DNA, 23 bp, synthetic construct
  source 1..23: mol_type = other DNA
cctgctgcctgctgtacygtgga

SEQ ID NO: 5367 - DNA, 23 bp, synthetic construct
  source 1..23: mol_type = other DNA
aggcragggcatggacgagatgg

SEQ ID NO: 5368 - DNA, 23 bp, synthetic construct
  source 1..23: mol_type = other DNA
ggtctrcgttcagctggcccggg

SEQ ID NO: 5369 - DNA, 23 bp, synthetic construct
  source 1..23: mol_type = other DNA
aggtctrcgttcagctggcccgg

SEQ ID NO: 5370 - DNA, 23 bp, synthetic construct
  source 1..23: mol_type = other DNA
gtccragtaccagcagtaccagg

SEQ ID NO: 5371 - DNA, 23 bp, synthetic construct
  source 1..23: mol_type = other DNA
gccrcctgcgacccgcgccacgg

SEQ ID NO: 5372 - DNA, 23 bp, synthetic construct
  source 1..23: mol_type = other DNA
gaacgccracctgcgcaagctgg

SEQ ID NO: 5373 - DNA, 23 bp, synthetic construct
  source 1..23: mol_type = other DNA
ccccggctggtcaggggtgygaa

SEQ ID NO: 5374 - DNA, 23 bp, synthetic construct
  source 1..23: mol_type = other DNA
cccggctggtcaggggtgygaag

SEQ ID NO: 5375 - DNA, 23 bp, synthetic construct
  source 1..23: mol_type = other DNA
ccggctggtcaggggtgygaagc

SEQ ID NO: 5376 - DNA, 23 bp, synthetic construct
  source 1..23: mol_type = other DNA
cttgcggcrgggcctggtcatgg

SEQ ID NO: 5377 - DNA, 23 bp, synthetic construct
  source 1..23: mol_type = other DNA
ccctcaacttccaaggcygggtc

SEQ ID NO: 5378 - DNA, 23 bp, synthetic construct
  source 1..23: mol_type = other DNA
cctcaacttccaaggcygggtca

SEQ ID NO: 5379 - DNA, 23 bp, synthetic construct
  source 1..23: mol_type = other DNA
gctacrccttctcggtctggagg

SEQ ID NO: 5380 - DNA, 23 bp, synthetic construct
  source 1..23: mol_type = other DNA
tcagctacrccttctcggtctgg

SEQ ID NO: 5381 - DNA, 23 bp, synthetic construct
  source 1..23: mol_type = other DNA
ccgggcagcccggccyagggcaa

SEQ ID NO: 5382 - DNA, 23 bp, synthetic construct
  source 1..23: mol_type = other DNA
ccttcgaggagctgyagagccag

SEQ ID NO: 5383 - DNA, 23 bp, synthetic construct
  source 1..23: mol_type = other DNA
cctgcacaacggctggyaggtgg

SEQ ID NO: 5384 - DNA, 23 bp, synthetic construct
  source 1..23: mol_type = other DNA
tgatcagcrgacgtggtctgggg

SEQ ID NO: 5385 - DNA, 23 bp, synthetic construct
  source 1..23: mol_type = other DNA
aggargcaccttggataagctgg

SEQ ID NO: 5386 - DNA, 23 bp, synthetic construct
  source 1..23: mol_type = other DNA
aagcaccarcttttctgccttgg

SEQ ID NO: 5387 - DNA, 23 bp, synthetic construct
  source 1..23: mol_type = other DNA
tgtgrccagctttcaggcagagg

SEQ ID NO: 5388 - DNA, 23 bp, synthetic construct
  source 1..23: mol_type = other DNA
cagtrctctggcaacttcatggg

SEQ ID NO: 5389 - DNA, 23 bp, synthetic construct
  source 1..23: mol_type = other DNA
ccagtrctctggcaacttcatgg

SEQ ID NO: 5390 - DNA, 23 bp, synthetic construct
  source 1..23: mol_type = other DNA
ccgggagtcgtggcyttccgtct

SEQ ID NO: 5391 - DNA, 23 bp, synthetic construct
  source 1..23: mol_type = other DNA
cctccgctggccatttcyctaga

SEQ ID NO: 5392 - DNA, 23 bp, synthetic construct
  source 1..23: mol_type = other DNA
ccgctggccatttcyctagagcc

SEQ ID NO: 5393 - DNA, 23 bp, synthetic construct
  source 1..23: mol_type = other DNA
ccgaaggcaccgtcytcttcaag

SEQ ID NO: 5394 - DNA, 23 bp, synthetic construct
  source 1..23: mol_type = other DNA
ccaatgccctggacaaygtggat

SEQ ID NO: 5395 - DNA, 23 bp, synthetic construct
  source 1..23: mol_type = other DNA
ccctgtaggcccagtcaccycca

SEQ ID NO: 5396 - DNA, 23 bp, synthetic construct
  source 1..23: mol_type = other DNA
cctgtaggcccagtcaccyccat

SEQ ID NO: 5397 - DNA, 23 bp, synthetic construct
  source 1..23: mol_type = other DNA
ccctatagtcccttttaccycca

SEQ ID NO: 5398 - DNA, 23 bp, synthetic construct
  source 1..23: mol_type = other DNA
cctatagtcccttttaccyccat

SEQ ID NO: 5399 - DNA, 23 bp, synthetic construct
  source 1..23: mol_type = other DNA
ccatcctgaccatggtgyggact

SEQ ID NO: 5400 - DNA, 23 bp, synthetic construct
  source 1..23: mol_type = other DNA
tggcactrtgagtgctccccggg

SEQ ID NO: 5401 - DNA, 23 bp, synthetic construct
  source 1..23: mol_type = other DNA
atggcactrtgagtgctccccgg

SEQ ID NO: 5402 - DNA, 23 bp, synthetic construct
  source 1..23: mol_type = other DNA
atggcactrccagtgcaaacagg

SEQ ID NO: 5403 - DNA, 23 bp, synthetic construct
  source 1..23: mol_type = other DNA
ccccagcgcgagtaccatayctg

SEQ ID NO: 5404 - DNA, 23 bp, synthetic construct
  source 1..23: mol_type = other DNA
cccagcgcgagtaccatayctgc

SEQ ID NO: 5405 - DNA, 23 bp, synthetic construct
  source 1..23: mol_type = other DNA
ccagcgcgagtaccatayctgca

SEQ ID NO: 5406 - DNA, 23 bp, synthetic construct
  source 1..23: mol_type = other DNA
ccgcattcgggagtytttctttc

SEQ ID NO: 5407 - DNA, 23 bp, synthetic construct
  source 1..23: mol_type = other DNA
ccagggatttgggcctttcygct

SEQ ID NO: 5408 - DNA, 23 bp, synthetic construct
  source 1..23: mol_type = other DNA
catcrctacattgccaacctggg

SEQ ID NO: 5409 - DNA, 23 bp, synthetic construct
  source 1..23: mol_type = other DNA
acatcrctacattgccaacctgg

SEQ ID NO: 5410 - DNA, 23 bp, synthetic construct
  source 1..23: mol_type = other DNA
ccattaagagaagagyaggacct

SEQ ID NO: 5411 - DNA, 23 bp, synthetic construct
  source 1..23: mol_type = other DNA
ccagctgcttcgcatcytcactg

SEQ ID NO: 5412 - DNA, 23 bp, synthetic construct
  source 1..23: mol_type = other DNA
cttgrccttatcagtgacagggg

SEQ ID NO: 5413 - DNA, 23 bp, synthetic construct
  source 1..23: mol_type = other DNA
tcttgrccttatcagtgacaggg

SEQ ID NO: 5414 - DNA, 23 bp, synthetic construct
  source 1..23: mol_type = other DNA
ttcttgrccttatcagtgacagg

SEQ ID NO: 5415 - DNA, 23 bp, synthetic construct
  source 1..23: mol_type = other DNA
ccatcggccccactayggctcgc

SEQ ID NO: 5416 - DNA, 23 bp, synthetic construct
  source 1..23: mol_type = other DNA
ccaggcaataatgaaggttyttt

SEQ ID NO: 5417 - DNA, 23 bp, synthetic construct
  source 1..23: mol_type = other DNA
actctctrggctgcctaccatgg

SEQ ID NO: 5418 - DNA, 23 bp, synthetic construct
  source 1..23: mol_type = other DNA
tcagrtaatgagaaacgataagg

SEQ ID NO: 5419 - DNA, 23 bp, synthetic construct
  source 1..23: mol_type = other DNA
ctcctrgaacccacccaaaaagg

SEQ ID NO: 5420 - DNA, 23 bp, synthetic construct
  source 1..23: mol_type = other DNA
tactrcattcctaatgatgcagg

SEQ ID NO: 5421 - DNA, 23 bp, synthetic construct
  source 1..23: mol_type = other DNA
ctcrgtactgaggcactgtgggg

SEQ ID NO: 5422 - DNA, 23 bp, synthetic construct
  source 1..23: mol_type = other DNA
gctcrgtactgaggcactgtggg

SEQ ID NO: 5423 - DNA, 23 bp, synthetic construct
  source 1..23: mol_type = other DNA
ggctcrgtactgaggcactgtgg

SEQ ID NO: 5424 - DNA, 23 bp, synthetic construct
  source 1..23: mol_type = other DNA
cctggatcccaccagaayagtct

SEQ ID NO: 5425 - DNA, 23 bp, synthetic construct
  source 1..23: mol_type = other DNA
ccctcgaagcatctgygaatcac

SEQ ID NO: 5426 - DNA, 23 bp, synthetic construct
  source 1..23: mol_type = other DNA
cctcgaagcatctgygaatcact

SEQ ID NO: 5427 - DNA, 23 bp, synthetic construct
  source 1..23: mol_type = other DNA
ccatgtgatctcttctaccyaag

SEQ ID NO: 5428 - DNA, 23 bp, synthetic construct
  source 1..23: mol_type = other DNA
ccatcrtcctgctggagctcagg

SEQ ID NO: 5429 - DNA, 23 bp, synthetic construct
  source 1..23: mol_type = other DNA
ggacaaccracgccactgccagg

SEQ ID NO: 5430 - DNA, 23 bp, synthetic construct
  source 1..23: mol_type = other DNA
ctgccrgctcaaacgctgtgtgg

SEQ ID NO: 5431 - DNA, 23 bp, synthetic construct
  source 1..23: mol_type = other DNA
caggcraagcatgaagcggaagg

SEQ ID NO: 5432 - DNA, 23 bp, synthetic construct
  source 1..23: mol_type = other DNA
ggagragcatgtcctgctcatgg

SEQ ID NO: 5433 - DNA, 23 bp, synthetic construct
  source 1..23: mol_type = other DNA
cctactccgacttctgcyagttc

SEQ ID NO: 5434 - DNA, 23 bp, synthetic construct
  source 1..23: mol_type = other DNA
ccagaagctagccgacctgygca

SEQ ID NO: 5435 - DNA, 23 bp, synthetic construct
  source 1..23: mol_type = other DNA
gcatcrgcaggaagtgtgattgg

SEQ ID NO: 5436 - DNA, 23 bp, synthetic construct
  source 1..23: mol_type = other DNA
agcratgcctccaggttgtccgg

SEQ ID NO: 5437 - DNA, 23 bp, synthetic construct
  source 1..23: mol_type = other DNA
ccgcgcgtcgtgctgcycgtatg

SEQ ID NO: 5438 - DNA, 23 bp, synthetic construct
  source 1..23: mol_type = other DNA
cctgtcrcacctccagctctcgg

SEQ ID NO: 5439 - DNA, 23 bp, synthetic construct
  source 1..23: mol_type = other DNA
tactacagrtctgtgggtattgg

SEQ ID NO: 5440 - DNA, 23 bp, synthetic construct
  source 1..23: mol_type = other DNA
cctttgccatccattygaatatt

SEQ ID NO: 5441 - DNA, 23 bp, synthetic construct
  source 1..23: mol_type = other DNA
ccaaacagaaattgccttygtac

SEQ ID NO: 5442 - DNA, 23 bp, synthetic construct
  source 1..23: mol_type = other DNA
cccaggtgctagagcggygaagc

SEQ ID NO: 5443 - DNA, 23 bp, synthetic construct
  source 1..23: mol_type = other DNA
ccaggtgctagagcggygaagct

SEQ ID NO: 5444 - DNA, 23 bp, synthetic construct
  source 1..23: mol_type = other DNA
gacrgctcccacgcctacatcgg

SEQ ID NO: 5445 - DNA, 23 bp, synthetic construct
  source 1..23: mol_type = other DNA
cctgctggatggctyctccaggc

SEQ ID NO: 5446 - DNA, 23 bp, synthetic construct
  source 1..23: mol_type = other DNA
cctcatcaatgagtgtgtcygag

SEQ ID NO: 5447 - DNA, 23 bp, synthetic construct
  source 1..23: mol_type = other DNA
cctgctttcctctcccagaygct

SEQ ID NO: 5448 - DNA, 23 bp, synthetic construct
  source 1..23: mol_type = other DNA
ccagagctcatttacycgcaatg

SEQ ID NO: 5449 - DNA, 23 bp, synthetic construct
  source 1..23: mol_type = other DNA
gatcragggaatggtcaggtagg

SEQ ID NO: 5450 - DNA, 23 bp, synthetic construct
  source 1..23: mol_type = other DNA
agaagatcragggaatggtcagg

SEQ ID NO: 5451 - DNA, 23 bp, synthetic construct
  source 1..23: mol_type = other DNA
cccagctgatcttgaatttyagc

SEQ ID NO: 5452 - DNA, 23 bp, synthetic construct
  source 1..23: mol_type = other DNA
ccagctgatcttgaatttyagca

SEQ ID NO: 5453 - DNA, 23 bp, synthetic construct
  source 1..23: mol_type = other DNA
cttrggctggcgggtagcccagg

SEQ ID NO: 5454 - DNA, 23 bp, synthetic construct
  source 1..23: mol_type = other DNA
acatcraggaagttttggcaagg

SEQ ID NO: 5455 - DNA, 23 bp, synthetic construct
  source 1..23: mol_type = other DNA
cgccagrtaggctgaggcctggg

SEQ ID NO: 5456 - DNA, 23 bp, synthetic construct
  source 1..23: mol_type = other DNA
ccgccagrtaggctgaggcctgg

SEQ ID NO: 5457 - DNA, 23 bp, synthetic construct
  source 1..23: mol_type = other DNA
caccattcrcttctggaacttgg

SEQ ID NO: 5458 - DNA, 23 bp, synthetic construct
  source 1..23: mol_type = other DNA
caggtgtrggtggtgaccaaagg

SEQ ID NO: 5459 - DNA, 23 bp, synthetic construct
  source 1..23: mol_type = other DNA
cctgtctcccagggcctgcyccc

SEQ ID NO: 5460 - DNA, 23 bp, synthetic construct
  source 1..23: mol_type = other DNA
aggrccgcctgggcagcaagtgg

SEQ ID NO: 5461 - DNA, 23 bp, synthetic construct
  source 1..23: mol_type = other DNA
gtgrgcatgccattcagcagcgg

SEQ ID NO: 5462 - DNA, 23 bp, synthetic construct
  source 1..23: mol_type = other DNA
cccaagtccctgcagaagyagag

SEQ ID NO: 5463 - DNA, 23 bp, synthetic construct
  source 1..23: mol_type = other DNA
ccaagtccctgcagaagyagagg

SEQ ID NO: 5464 - DNA, 23 bp, synthetic construct
  source 1..23: mol_type = other DNA
ccatcaacatgctccygttcttc

SEQ ID NO: 5465 - DNA, 23 bp, synthetic construct
  source 1..23: mol_type = other DNA
cctcaacgtcagcgtccygtgcc

SEQ ID NO: 5466 - DNA, 23 bp, synthetic construct
  source 1..23: mol_type = other DNA
ctctrtgtgagtggggccattgg

SEQ ID NO: 5467 - DNA, 23 bp, synthetic construct
  source 1..23: mol_type = other DNA
cctcagcgtgtttacygaaatcg

SEQ ID NO: 5468 - DNA, 23 bp, synthetic construct
  source 1..23: mol_type = other DNA
cccaaactcaccacttcyaaccc

SEQ ID NO: 5469 - DNA, 23 bp, synthetic construct
  source 1..23: mol_type = other DNA
ccaaactcaccacttcyaacccc

SEQ ID NO: 5470 - DNA, 23 bp, synthetic construct
  source 1..23: mol_type = other DNA
cagccccracatgggcttcgggg

SEQ ID NO: 5471 - DNA, 23 bp, synthetic construct
  source 1..23: mol_type = other DNA
gcagccccracatgggcttcggg

SEQ ID NO: 5472 - DNA, 23 bp, synthetic construct
  source 1..23: mol_type = other DNA
ggcrgctgcagccccgacatggg

SEQ ID NO: 5473 - DNA, 23 bp, synthetic construct
  source 1..23: mol_type = other DNA
gggcrgctgcagccccgacatgg

SEQ ID NO: 5474 - DNA, 23 bp, synthetic construct
  source 1..23: mol_type = other DNA
ccaggagtgccagcacyagttcc

SEQ ID NO: 5475 - DNA, 23 bp, synthetic construct
  source 1..23: mol_type = other DNA
cctctctrcagccaactggcagg

SEQ ID NO: 5476 - DNA, 23 bp, synthetic construct
  source 1..23: mol_type = other DNA
acctacrccatcattgccgccgg

SEQ ID NO: 5477 - DNA, 23 bp, synthetic construct
  source 1..23: mol_type = other DNA
ccacactgccacagtttygggag

SEQ ID NO: 5478 - DNA, 23 bp, synthetic construct
  source 1..23: mol_type = other DNA
gagcrgggctgtctctgtgtggg

SEQ ID NO: 5479 - DNA, 23 bp, synthetic construct
  source 1..23: mol_type = other DNA
cgagcrgggctgtctctgtgtgg

SEQ ID NO: 5480 - DNA, 23 bp, synthetic construct
  source 1..23: mol_type = other DNA
cctgtgctgggatctcyggcagt

SEQ ID NO: 5481 - DNA, 23 bp, synthetic construct
  source 1..23: mol_type = other DNA
cccacctctgctttyatcccgat

SEQ ID NO: 5482 - DNA, 23 bp, synthetic construct
  source 1..23: mol_type = other DNA
cccccttgatttggagygagcag

SEQ ID NO: 5483 - DNA, 23 bp, synthetic construct
  source 1..23: mol_type = other DNA
ccccttgatttggagygagcagg

SEQ ID NO: 5484 - DNA, 23 bp, synthetic construct
  source 1..23: mol_type = other DNA
cccttgatttggagygagcaggc

SEQ ID NO: 5485 - DNA, 23 bp, synthetic construct
  source 1..23: mol_type = other DNA
ccagtgtaaaacttgtcagygaa

SEQ ID NO: 5486 - DNA, 23 bp, synthetic construct
  source 1..23: mol_type = other DNA
cccacaggaaatctgtgcygctg

SEQ ID NO: 5487 - DNA, 23 bp, synthetic construct
  source 1..23: mol_type = other DNA
ccacaggaaatctgtgcygctgc

SEQ ID NO: 5488 - DNA, 23 bp, synthetic construct
  source 1..23: mol_type = other DNA
ccataattrgtaccagctactgg

SEQ ID NO: 5489 - DNA, 23 bp, synthetic construct
  source 1..23: mol_type = other DNA
gaaggactrcaggggagagaggg

SEQ ID NO: 5490 - DNA, 23 bp, synthetic construct
  source 1..23: mol_type = other DNA
tgcrggcaaagaaggtaggccgg

SEQ ID NO: 5491 - DNA, 23 bp, synthetic construct
  source 1..23: mol_type = other DNA
aacttgcrggcaaagaaggtagg

SEQ ID NO: 5492 - DNA, 23 bp, synthetic construct
  source 1..23: mol_type = other DNA
tctgttcrcactttctctttcgg

SEQ ID NO: 5493 - DNA, 23 bp, synthetic construct
  source 1..23: mol_type = other DNA
cctgactccacagcatgttygag

SEQ ID NO: 5494 - DNA, 23 bp, synthetic construct
  source 1..23: mol_type = other DNA
tactggrgaacggcaaccacggg

SEQ ID NO: 5495 - DNA, 23 bp, synthetic construct
  source 1..23: mol_type = other DNA
ttactggrgaacggcaaccacgg

SEQ ID NO: 5496 - DNA, 23 bp, synthetic construct
  source 1..23: mol_type = other DNA
ctgtctctrggagtcctcagtgg

SEQ ID NO: 5497 - DNA, 23 bp, synthetic construct
  source 1..23: mol_type = other DNA
ggcggcccrcaacgtcctgctgg

SEQ ID NO: 5498 - DNA, 23 bp, synthetic construct
  source 1..23: mol_type = other DNA
ccgtgacctggcggccygcaacg

SEQ ID NO: 5499 - DNA, 23 bp, synthetic construct
  source 1..23: mol_type = other DNA
ccttaaaggattacyttatcaag

SEQ ID NO: 5500 - DNA, 23 bp, synthetic construct
  source 1..23: mol_type = other DNA
cccacatcagaatccatyggtaa

SEQ ID NO: 5501 - DNA, 23 bp, synthetic construct
  source 1..23: mol_type = other DNA
ccacatcagaatccatyggtaaa

SEQ ID NO: 5502 - DNA, 23 bp, synthetic construct
  source 1..23: mol_type = other DNA
agcrccgtttcacgcagtccggg

SEQ ID NO: 5503 - DNA, 23 bp, synthetic construct
  source 1..23: mol_type = other DNA
gagcrccgtttcacgcagtccgg

SEQ ID NO: 5504 - DNA, 23 bp, synthetic construct
  source 1..23: mol_type = other DNA
ccccatcaacccatayaaggacc

SEQ ID NO: 5505 - DNA, 23 bp, synthetic construct
  source 1..23: mol_type = other DNA
cccatcaacccatayaaggacca

SEQ ID NO: 5506 - DNA, 23 bp, synthetic construct
  source 1..23: mol_type = other DNA
ccagtattcctgggctaygacca

SEQ ID NO: 5507 - DNA, 23 bp, synthetic construct
  source 1..23: mol_type = other DNA
ccatctgaaagaacacctgygaa

SEQ ID NO: 5508 - DNA, 23 bp, synthetic construct
  source 1..23: mol_type = other DNA
ccccctgccaggcacyagtgggt

SEQ ID NO: 5509 - DNA, 23 bp, synthetic construct
  source 1..23: mol_type = other DNA
cccctgccaggcacyagtgggta

SEQ ID NO: 5510 - DNA, 23 bp, synthetic construct
  source 1..23: mol_type = other DNA
ccacatccgagtgcacaygggcg

SEQ ID NO: 5511 - DNA, 23 bp, synthetic construct
  source 1..23: mol_type = other DNA
ctgactrgttgttctcaatgtgg

SEQ ID NO: 5512 - DNA, 23 bp, synthetic construct
  source 1..23: mol_type = other DNA
ccttcctagcacagcggyaggtg

SEQ ID NO: 5513 - DNA, 23 bp, synthetic construct
  source 1..23: mol_type = other DNA
ccctaactgaaaccyagcctcct

SEQ ID NO: 5514 - DNA, 23 bp, synthetic construct
  source 1..23: mol_type = other DNA
ccttctgaaaacattyaagatat

SEQ ID NO: 5515 - DNA, 23 bp, synthetic construct
  source 1..23: mol_type = other DNA
gcagcrgtgaggccagatactgg

SEQ ID NO: 5516 - DNA, 23 bp, synthetic construct
  source 1..23: mol_type = other DNA
ccagctgcctgaactgcggygcc

SEQ ID NO: 5517 - DNA, 23 bp, synthetic construct
  source 1..23: mol_type = other DNA
ccggccctccctgcggctgyatc

SEQ ID NO: 5518 - DNA, 23 bp, synthetic construct
  source 1..23: mol_type = other DNA
ccctccctgcggctgyatcgcaa

SEQ ID NO: 5519 - DNA, 23 bp, synthetic construct
  source 1..23: mol_type = other DNA
cctccctgcggctgyatcgcaag

SEQ ID NO: 5520 - DNA, 23 bp, synthetic construct
  source 1..23: mol_type = other DNA
aaacccrgccccagctcccaggg

SEQ ID NO: 5521 - DNA, 23 bp, synthetic construct
  source 1..23: mol_type = other DNA
caaacccrgccccagctcccagg

SEQ ID NO: 5522 - DNA, 23 bp, synthetic construct
  source 1..23: mol_type = other DNA
cctgtrcccccggtgcccccggg

SEQ ID NO: 5523 - DNA, 23 bp, synthetic construct
  source 1..23: mol_type = other DNA
acctgtrcccccggtgcccccgg

SEQ ID NO: 5524 - DNA, 23 bp, synthetic construct
  source 1..23: mol_type = other DNA
cccccagaccccacyggggagaa

SEQ ID NO: 5525 - DNA, 23 bp, synthetic construct
  source 1..23: mol_type = other DNA
ccttcccccaggggagacycctg

SEQ ID NO: 5526 - DNA, 23 bp, synthetic construct
  source 1..23: mol_type = other DNA
cccccaggggagacycctgctca

SEQ ID NO: 5527 - protein, 9 aa, synthetic construct
DGLHAGSPA

SEQ ID NO: 5528 - protein, 12 aa, synthetic construct
VERLFGYDWAQQ

SEQ ID NO: 5529 - protein, 10 aa, synthetic construct
DGLHAGSPAA

SEQ ID NO: 5530 - protein, 16 aa, synthetic construct
VERLFGYDWAQQTIGC
